US011230712B2

(12) United States Patent
Kordasiewicz et al.

(10) Patent No.: US 11,230,712 B2
(45) Date of Patent: Jan. 25, 2022

(54) COMPOUNDS AND METHODS FOR REDUCING SNCA EXPRESSION

(71) Applicant: Ionis Pharmaceuticals, Inc., Carlsbad, CA (US)

(72) Inventors: Holly Kordasiewicz, San Diego, CA (US); Tracy A. Cole, Encinitas, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 16/759,698

(22) PCT Filed: Nov. 9, 2018

(86) PCT No.: PCT/US2018/060097
§ 371 (c)(1),
(2) Date: Apr. 27, 2020

(87) PCT Pub. No.: WO2019/164562
PCT Pub. Date: Aug. 29, 2019

(65) Prior Publication Data
US 2020/0392494 A1 Dec. 17, 2020

Related U.S. Application Data

(60) Provisional application No. 62/584,009, filed on Nov. 9, 2017.

(51) Int. Cl.
*C12N 15/113* (2010.01)
*A61P 25/16* (2006.01)

(52) U.S. Cl.
CPC ............ *C12N 15/113* (2013.01); *A61P 25/16* (2018.01); *C12N 2310/11* (2013.01); *C12N 2310/31* (2013.01); *C12N 2310/315* (2013.01); *C12N 2310/322* (2013.01); *C12N 2310/341* (2013.01); *C12N 2310/351* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,102,785 A | 4/1992 | Livak et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |

(Continued)

FOREIGN PATENT DOCUMENTS

| | | |
|---|---|---|
| WO | WO 2017/119463 | 7/1917 |
| WO | WO 2019/140231 | 7/1919 |

(Continued)

OTHER PUBLICATIONS

Abeliovich et al., "Mice lacking alpha-synuclein display functional deficits in the nigrostriatal dopamine system." Neuron (2000) 25(1):239-252.

(Continued)

*Primary Examiner* — Tracy Vivlemore
(74) *Attorney, Agent, or Firm* — McNeill Baur PLLC

(57) ABSTRACT

Provided are compounds, methods, and pharmaceutical compositions for reducing the amount or activity of SNCA mRNA in a cell or animal, and in certain instances reducing the amount of alpha-synuclein protein in a cell or animal. Such compounds, methods, and pharmaceutical compositions are useful to ameliorate at least one symptom or hallmark of a neurodegenerative disease. Such symptoms and hallmarks include motor dysfunction, aggregation of alpha-synuclein, neurodegeneration, cognitive decline and dementia. Such neurodegenerative diseases include Parkinson's disease, dementia with Lewy bodies, diffuse Lewy body disease, pure autonomic failure, multiple system atrophy, neuronopathic Gaucher's disease and Alzheimer's disease.

25 Claims, No Drawings
Specification includes a Sequence Listing.

(56) References Cited

U.S. PATENT DOCUMENTS

| | | |
|---|---|---|
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Hamlambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistum et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,268,490 B1 | 7/2001 | Imanishi et al. |
| 6,277,640 B1 | 8/2001 | Bennett et al. |
| 6,300,319 B1 | 10/2001 | Manoharan |
| 6,426,220 B1 | 7/2002 | Bennett et al. |
| 6,455,308 B1 | 9/2002 | Freier et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,770,748 B2 | 8/2004 | Imanishi et al. |
| 6,794,499 B2 | 9/2004 | Wengel et al. |
| 6,833,361 B2 | 12/2004 | Hong et al. |
| 7,015,315 B1 | 3/2006 | Cook et al. |
| 7,034,133 B2 | 4/2006 | Wengel et al. |
| 7,053,207 B2 | 5/2006 | Wengel |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,579,458 B2 | 8/2009 | Khvorova et al. |
| 7,595,306 B2 | 9/2009 | Bumcrot |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,750,141 B2 | 7/2010 | Crooke et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,389,487 B2 | 3/2013 | Bohn et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,663,783 B2 | 5/2017 | Freier |
| 10,815,480 B2 | 10/2020 | Freier |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2004/0219671 A1 | 11/2004 | McSwiggen |
| 2004/0226056 A1 | 11/2004 | Roch et al. |
| 2005/0064548 A1 | 3/2005 | Lindquist et al. |

(56) References Cited

U.S. PATENT DOCUMENTS

| | | |
|---|---|---|
| 2005/0130923 A1 | 6/2005 | Bhat et al. |
| 2005/0137155 A1 | 6/2005 | McSwiggen et al. |
| 2006/0148740 A1 | 7/2006 | Platenburg |
| 2007/0031844 A1 | 2/2007 | Khvorova et al. |
| 2007/0161595 A1 | 7/2007 | Bumcrot et al. |
| 2007/0192879 A1 | 8/2007 | Yoshimoto et al. |
| 2007/0225209 A1 | 9/2007 | Roch et al. |
| 2007/0287831 A1 | 12/2007 | Seth et al. |
| 2008/0003570 A1 | 1/2008 | Rogers et al. |
| 2008/0039418 A1 | 2/2008 | Freier |
| 2008/0039618 A1 | 2/2008 | Allerson et al. |
| 2009/0092981 A1 | 4/2009 | Swayze et al. |
| 2009/0176729 A1 | 7/2009 | Tan |
| 2010/0190837 A1 | 7/2010 | Migawa et al. |
| 2010/0197762 A1 | 8/2010 | Swayze et al. |
| 2010/0204306 A1 | 8/2010 | Tan |
| 2011/0054005 A1 | 3/2011 | Naito et al. |
| 2012/0129912 A1 | 5/2012 | Mouradian et al. |
| 2012/0322991 A1 | 12/2012 | Montefeltro et al. |
| 2013/0130378 A1 | 5/2013 | Manoharan et al. |
| 2014/0005252 A1 | 1/2014 | Bennett et al. |
| 2014/0107330 A1 | 4/2014 | Freier et al. |
| 2014/0120158 A1 | 5/2014 | Montefeltro et al. |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2017/0044526 A1 | 2/2017 | Wan et al. |
| 2017/0275621 A1 | 9/2017 | Butler et al. |
| 2018/0073022 A1 | 3/2018 | Freier |
| 2020/0040061 A1* | 2/2020 | Lundberg ........... A61K 48/0075 |
| 2021/0087562 A1 | 3/2021 | Freier |

FOREIGN PATENT DOCUMENTS

| | | |
|---|---|---|
| WO | WO 2019/140236 | 7/1919 |
| WO | WO 2019/164562 | 8/1919 |
| WO | WO 2001/057277 | 8/2001 |
| WO | WO 2001/077384 | 10/2001 |
| WO | WO 2003/004602 | 1/2003 |
| WO | WO 2004/106356 | 12/2004 |
| WO | WO 2005/021570 | 3/2005 |
| WO | WO 2005/097817 | 10/2005 |
| WO | WO 2006/034348 | 3/2006 |
| WO | WO 2007/134181 | 11/2007 |
| WO | WO 2007/135426 | 11/2007 |
| WO | WO 2008/101157 | 8/2008 |
| WO | WO 2008/109509 | 9/2008 |
| WO | WO 2008/150729 | 12/2008 |
| WO | WO 2008/154401 | 12/2008 |
| WO | WO 2009/006478 | 1/2009 |
| WO | WO 2009/079399 | 6/2009 |
| WO | WO 2011/131693 | 10/2011 |
| WO | WO 2012/068405 | 5/2012 |
| WO | WO 2013/173637 | 11/2013 |
| WO | WO 2014/064257 | 5/2014 |

OTHER PUBLICATIONS

Alarcon-Aris et al., "Selective alpha-Synuclein Knockdown in Monoamine Neurons by Intranasal Oligonucleotide Delivery: Potential Therapy for Parkinison's Disease" Molecular Therapy (2018) 26(2): 1-18.

Albaek et al., "Analogues of a Locked Nucleic Acid with Three-Carbon 2',4'-Linkages: Synthesis by Ring-Closing Metathesis and Influence on Nucleic Acid Duplex Stability and Structure" J. Org. Chem. (2006) 71:7731-7740.

Altmann et al., "Second-generation antisense oligonucleotides: structure-activity relationships and the design of improved signal-transduction inhibitors" Biochem. Soc. Trans. (1996) 24:630-637.

Altmann et al., "Second Generation of Antisense Oligonucleotides: From Nuclease Resistance to Biological Efficacy in Animals" Chimia (1996) 50(4):168-176.

Altmann et al., "Second Generation Antisense Oligonucleotides—Inhibition of PKC-a and c-RAF Kinase Expression by Chimeric Oligonucleotides Incorporating 6'-Substituted Carbocyclic Nucleosides and 2'-O-Ethylene Glycol Substituted Ribonucleosides" Nucleosides Nucleotides (1997) 16(7-9):917-926.

Altschul et al., "Basic Local Alignment Search Tool" J. Mol. Biol. (1990) 215:403-410.

Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272(18):11944-12000.

Braasch et al., "Locked nucleic acid (LNA): fine-tuning the recognition of DNA and RNA" Chem. Biol. (2001) 8:1-7.

Branch et al., "A good antisense molecule is hard to find," TIBS (1998) 23:45-50.

Burre et al., "Alpha-synuclein promotes SNARE-complex assembly in vivo and in vitro." Science (2010) 329(5999): 1663-1667.

Cabin et al., "Synaptic vesicle depletion correlates with attenuated synaptic responses to prolonged repetitive stimulation in mice lacking alpha-synuclein." J. Neurosci. (2002) 22(20):8797-8807.

Chan et al. "Antisense Oligonucleotides: from design to therapeutic application" Clinical and Experimental Pharmacology and Physiology (2006) 533-540.

Chen et al., "RNA interference targeting a-synuclein attenuates methamphetamine-induced neurotoxicity in SH-SY5Y cells" Brain Research (2013) 1521: 59-67.

Chiasson et al., "The application of antisense oligonucleotide technology to the brain: some pitfalls." Cellular and Molecular Neurobiology (1994) 14(5):507-521.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Clayton et al., "Synucleins in synaptic plasticity and neurodegenerative disorders" J. Neurosci. (1999) 58(1):120-129.

Cole et al., "Alpha-synuclein antisense oligonucleotides as a disease-modifying therapy for Parkinson's disease" bioRxiv preprint (2019) 1-42.

Conway et al., "Kinetic Stabilization of the α-Synuclein Protofibril by a Dopamine-α-Synuclein Adduct" Science (2001) 294(5545):1346-1349.

Crooke et al., "Basic Principles of Antisense Therapeutics" Antisense Research and Application (1998) Chapter 1:1-50.

Davidson et al., "Stabilization of alpha-synuclein secondary structure upon binding to synthetic membranes." J. Bioi. Chem. (1998) 273(16):9443-9449.

Elayadi et al., "Application of PNA and LNA oligomers to chemotherapy" Curr. Opinions Invens. Drugs (2001) 2:558-561.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

European Search Report for application EP 11840796.4 dated Dec. 4, 2014.

Fleming et al., "Early and Progressive Sensorimotor Anomalies in Mice Overexpressing Wild-Type Human α-Synuclein" J. Neurosci. (2004) 24(42):9434-9440.

Fleming et al., "Olfactory deficits in mice overexpressing human wildtype alpha-synuclein." Eur. J. Neurosci. (2008) 28(2):247-256.

Fountaine et al., "RNA Interference-Mediated Knockdown of a-Synuclein Protects Human Dopaminergic Neuroblastoma Cells From MPP+ Toxicity and Reduces Dopamine Transport" Journal of Neuroscience Research (2007) 85:351-363.

Freier et al., "The ups and downs of nucleic acid duplex stability: structure-stability studies on chemically-modified DNA:RNA duplexes" Nucleic Acids Research (1997) 25(22):4429-4443.

Frieden et al., "Expanding the design horizon of antisense oligonucleotides with alpha-L-LNA" Nucleic Acids Research (2003) 31(21):6365-6372.

(56) References Cited

OTHER PUBLICATIONS

Gautschi et al., "Activity of a Novel bcl-2/bcl-xL-Bispecific Antisense Oligonucleotide Against Tumors of Diverse Histologic Origins" Gautschi et al. (2001) 93(6):463-471.
GenBank Accession No. NM 000345.3.
Gorbatyuk et al., "In Vivo RNAi-Mediated α-Synuclein Silencing Induces Nigrostriatal Degeneration" Mol. Ther. (2010) 18(8): 1450-1457.
Henry et al., "Chemically Modified Oligonucleotides Exhibit Decreased Immune Stimulation in Mice" J Pharma Exp Ther (2000) 468-479.
International Search Report for application PCT/US11/61245 dated May 18, 2012.
International Search Report for application PCT/US18/60097 dated Sep. 30, 2019.
Iwai et al., "The precursor protein of non-A beta component of Alzheimer's disease amyloid is a presynaptic protein of the central nervous system." Neuron (1995) 14(2):467-475.
Koshkin et al., "LNA (Locked Nucleic Acids): Synthesis of the Adenine, Cytosine, Guanine, 5-Methylcytosine, Thymine and Uracil Bicyclonucleoside Monomers, Oligomerisation, and Unprecedented Nucleic Acid Recognition" Tetrahedron (1998) 54:3607-3630.
Kramer et al., "Presynaptic—Synuclein Aggregates, Not Lewy Bodies, Cause Neurodegenemtion in Dementia with Lewy Bodies" J. Neurosci. (2007) 27(6):1405-1410.
Kumar et al., "The First Analogues of LNA (Locked Nucleic Acids): Phosphorothioate-LNA and 2'-Thio-LNA" Bioorg. Med. Chem. Lett. (1998) 8:2219-2222.
Lee et al., "Membrane-bound α-Synuclein Has a High Aggregation Propensity and the Ability to Seed the Aggregation of the Cytosolic Form" J. Biol. Chem. (2002) 277(1):671-678.
Leumann, "DNA Analogues: From Supramolecular Principles to Biological Properties" Bioorganic & Medicinal Chemistry (2002) 10:841-854.
Lewis et al., "In vivo silencing of alpha-synuclein using naked siRNA" Mol Neurodegener (2008) 3:19.
Liu et al., "a-Synuclein produces a long-lasting increase in neurotransmitter release" The EMBO Journal (2004) 23:4506-4516.
Luna et al., "Differential alpha-synuclein expression contributes to selective vulnerability of hippocampal neuron subpopulations to figril-induced toxicity" Acta Neuropathol (2018). Publised online Mar. 3, 2018 https://doi.org/10.1007/s00401-018-1829-8.
Maguire-Zeiss et al., "a-Synuclein: A therapeutic target for Parkinson's disease?" Pharmacol Res (2008) 58:271-280.
Maher et al., "Comparative hybrid arrest by tandem antisense oligodeoxyribonucleotides or oligodeoxyribonucleoside methylpbosphonates in a cell-free system" Nucl. Acids. Res. (1988) 16(8):3341-3358.
Marti et al., "Clinical Overview of the Synucleinopathies" Movement Disorders (2003) 18(6):S21-S27.
Martin, "Ein neuer Zugang zu 2'-O-Alkylribonucleosiden and Eigenschaften deren Oligonucleotide" Helv. Chim. Acta (1995) 78:486-504.
McCormack et al., "a-Synuclein Suppression by Targeted Small Interfering RNA in the Primate Substantia Nigro" PLoS One (2010) 5(8):e12122.
Monti et al., "Alpha-synuclein protects cerebellar granule neurons against 6-hydroxydopamine-induced death" J. of Neurochemistry (2007) 103:518-530.
Murphy et al., "Synucleins Are Developmentally Expressed, and a-Synuclein Regulates the Size of the Presynaptic Vesicular Pool in Primly Hippocampal Neurons" The Journal of Neuroscience (2000) 20(9):3214-3220.

New England Biolabs 1998/99 Catalog (cover page and pp. 121 and 284).
Orum et al., "Locked nucleic acids: A promising molecular family for gene-function analysis and antisense drug development" Curr. Opinion Mol. Ther. (2001) 3:239-243.
Reynolds et al., "Rational siRNA design for RNA interference" Nature Biotechnology (2004) 22(3):326-330.
Rockenstein et al., "Differential neuropathological alterations in transgenic mice expressing alpha-synuclein from the platelet-derived growth factor and Thy-1 promoters." J. Neurosci. Res. (2002) 68(5):568-578.
Sanghvi et al., "Heterocyclic Base Modifications in Nucleic Acids and Their Applications in Antisense Oligonucleotides" Antisense Research and Applications (1993) pp. 273-288.
Sapru et al., "Silencing of human α-synuclein in vitro and in rat brain using lentiviral-mediated RNAi" Exp. Neurol. (2006) 198:382-390.
Schulz-Schaeffer, "The synaptic pathology of α-synuclein aggregation in dementia with Lewy bodies, Parkinson's disease and Parkinson's disease dementia" Acta Neuropathologica (2010) 120(2):131-143.
Seema et al., "In-silico analysis for RNA-interference mechanism of α-synuclein to treat Parkinson's disease" Int. J. Bioinformatics Research and App (2013) 9(6) Abstract Only.
Sibley et al., "Identification of Allele-Specific RNAi Effectors Targeting Genetic Forms of Parkinson's Disease" PLOS One (2011) 6(10): e26194.
Singh et al., "LNA (locked nucleic acids): synthesis and high-affinity nucleic acid recognition" Chem. Commun. (1998) 4:455-456.
Singh et al., "Synthesis of 2'-Amino-LNA: A Novel Conformationally Restricted High-Affinity Oligonucleotide Analogue with a Handle" J. Org. Chem. (1998) 63:10035-10039.
Souza et al., "Chaperone-like activity of synucleins." FEBS Lett. (2000) 474(1):116-119.
Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26): 8362-8379.
Uversky, "Neuropathology, biochemistry, and biophysics of alpha-synuclein aggregation." J. Neurochem. (2007) 103(1): 17-37.
Vickers et al., "Efficient reduction of target RNAs by small interfering RNA and RNase H-dependent antisense agents. A comparative analysis" J Biol Chem (2003) 278(9): 7108-7118.
Vickers et al., "Effects of RNA secondary stucture on cellular antisense activity" Nucleic Acids Res (2000) 1340-1347.
Volpicelli-Daley et al., "G2019S-LRRK2 Expression Augments alpha-Synuclein Sequestration into Inclusions in Neurons" J. Neuroscience (2016) 36(28):7415-7427.
Wahlestedt et al., "Potent and nontoxic antisense oligonucleotides containing locked nucleic acids" PNAS (2000) 97:5633-5638.
Woolf et al., "Specificity of antisense oligonucleotides in vivo" PNAS (1992) 89:7305-7309.
Xu et al., "Effective Small Interfering RNAs and Phosphorothioate Antisense DNAs have different preferences for Target Sites in the Luciferase mRNAs" Biochemical and Biophysical Research Communications (2003) 306:712-717.
Yoshida, "Multiple system atrophy: alpha-synuclein and neuronal degeneration." Neuropathology (2007) 27(5):484-493.
Zhang et al., "PowerBLAST: A New Network BLAST Application for Interactive or Automated Sequence Analysis and Annotation" Genome Res. (1997) 7:649-656.
Zhou e al., "Fine Tuning of Electrostatics around the Internucleotidic Phosphate through Incorporation of Modified 2',4'-Carhocyclic-LNAs and -ENAs Leads to Significant Modulation of Antisense Properties" J. Org. Chem. (2009) 74:118-134.

\* cited by examiner

COMPOUNDS AND METHODS FOR REDUCING SNCA EXPRESSION

SEQUENCE LISTING

The present application is being filed along with a Sequence Listing in electronic format. The Sequence Listing is provided as a file entitled BIOL0289USASEQ_ST25.txt, created on Apr. 27, 2020, which is 712 KB in size. The information in the electronic format of the sequence listing is incorporated herein by reference in its entirety.

FIELD

Provided are compounds, methods, and pharmaceutical compositions for reducing the amount or activity of alpha-synuclein (SNCA) mRNA in a cell or animal, and in certain instances reducing the amount of alpha-synuclein protein in a cell or animal. Such compounds, methods, and pharmaceutical compositions are useful to ameliorate at least one symptom or hallmark of a neurodegenerative disease. Such symptoms and hallmarks include motor dysfunction, aggregation of alpha-synuclein, neurodegeneration, cognitive decline and dementia. Such neurodegenerative diseases include Parkinson's disease, dementia with Lewy bodies, diffuse Lewy body disease, pure autonomic failure, multiple system atrophy, neuronopathic Gaucher's disease and Alzheimer's disease.

BACKGROUND

Alpha-synuclein is a small, highly charged 140-amino acid residue protein, predominantly expressed in central nervous system (CNS) neurons, where it is localized at presynaptic terminals in close proximity to synaptic vesicles (Iwai, et al., Neuron. 1995. 14: 467-475). Alpha-synuclein is encoded by the SNCA gene. Alpha-synuclein can associate with lipid membranes by forming amphipathic α-helices, as shown in vitro (Davidson, et al., J. Biol. Chem. 1998. 273: 9443-9449). Although the function of alpha-synuclein is still poorly understood, several studies suggest that it is involved in modulating synaptic transmission, the density of synaptic vesicles, and neuronal plasticity (Cabin et al., J. Neurosci. 2002. 22: 8797-8807). It has also been suggested that alpha-synuclein may have a chaperone function, as indicated by its effectiveness in preventing aggregation of proteins in in vitro assays (Souza et al., FEBS Lett. 2000. 474: 116-119). Moreover, in vivo assays demonstrate that alpha-synuclein chaperone activity is instrumental in promoting the assembly of the SNARE-complex, which is essential for neurotransmitter release in the presynaptic terminals of the brain (Burre et al., Science. 329: 1663-1667). Decreased SNARE-complex assembly is associated with neurological impairment, thus, indicating a link between presynaptic alpha-synuclein aggregates and neurodegeneration (Kramer and Schulz-Schaeffer, J.Neurosci. 2007. 27: 1405-1410). Knockout mouse models of alpha-synuclein are not lethal, and brain morphology is intact, suggesting that alpha-synuclein is not required for neuronal development and/or that compensatory pathways are present (Abeliovich et al., Neuron. 2000. 25: 239-252).

Misfolding, aggregation, and fibrillation of alpha-synuclein are implicated as critical factors in several neurodegenerative diseases, including, Parkinson's disease, Lewy body variant of Alzheimer's disease, diffuse Lewy body disease, dementia with Lewy bodies, and multiple system atrophy (Schulz-Schaeffer Acta Neuropathol. 2010. 120: 131-143; Yoshida. Neuropathology. 2007. 27: 484-493). In each of these cases, alpha-synuclein protein is misfolded and assembles in aggregates in Lewy bodies and Lewy neurites (Uversky. J. Neurochem. 2007. 103: 17-37). Several recent studies have shown that lipidic environments that promote alpha-synuclein folding also accelerate alpha-synuclein aggregation, suggesting that the lipid-associated conformation of alpha-synuclein may be relevant to alpha-synuclein misfolding in neurodegenerative diseases (Conway et al., Science. 2001. 294: 6-9; Lee et al., J. Biol. Chem. 2002. 277: 671-678). Mutations at position 53, where alanine is changed to threonine, and at position 30, where alanine is changed to proline, have been shown to cause alpha-synuclein to be in a random coil state, so that aggregation is more likely to occur (Clayton and George, J. Neurosci. 1999. 58: 120-129).

Currently there is a lack of acceptable options for treating neurodegenerative disease such as Parkinson's disease, dementia with Lewy bodies, diffuse Lewy body disease, pure autonomic failure, multiple system atrophy, neuronopathic Gaucher's disease and Alzheimer's disease. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of SNCA mRNA, and in certain embodiments reducing the amount of alpha-synuclein protein in a cell or animal. In certain embodiments, the animal has a neurodegenerative disease. In certain embodiments, the animal has Parkinson's disease, dementia with Lewy bodies, diffuse Lewy body disease, pure autonomic failure, multiple system atrophy, neuronopathic Gaucher's disease or Alzheimer's disease. In certain embodiments, compounds useful for reducing expression of SNCA mRNA are oligomeric compounds. In certain embodiments, compounds useful for reducing expression of SNCA mRNA are modified oligonucleotides.

Also provided are methods useful for ameliorating at least one symptom or hallmark of a neurodegenerative disease. In certain embodiments, the neurodegenerative disease is Parkinson's disease, dementia with Lewy bodies, diffuse Lewy body disease, pure autonomic failure, multiple system atrophy, neuronopathic Gaucher's disease and Alzheimer's disease. In certain embodiments, the symptom or hallmark includes motor dysfunction, aggregation of alpha-synuclein, neurodegeneration, cognitive decline and dementia. In certain embodiments, amelioration of these symptoms results in improved motor function, reduction of alpha-synuclein aggregates, reduced neurodegeneration and/or reduced dementia.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyribosy sugar moiety, as found in naturally occurring deoxyribonucleic acids (DNA). In certain embodiments, a 2'-deoxynucleoside may comprise a modified nucleobase or may comprise an RNA nucleobase (uracil).

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is motor dysfunction, aggregation of alpha-synuclein, neurodegeneration, cognitive decline and/or dementia. In certain embodiments, amelioration of these symptoms results in improved motor function, reduction of alpha-synuclein aggregates, reduced neurodegeneration and/or reduced dementia.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "cEt nucleoside" means a nucleoside comprising cEt modified sugar.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moieties of the nucleosides of the gap of a gapmer are unmodified 2'-deoxyribosyl. Thus, the term "MOE gapmer" indicates a gapmer having a sugar motif of 2'-MOE nucleosides in both wings and a gap of 2'-deoxynucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "MOE" means methoxyethyl. "2'-MOE" or "2'-MOE modified sugar" means a 2'-OCH$_2$CH$_2$OCH$_3$ group in place of the 2'—OH group of a ribosyl sugar moiety.

As used herein, "2'-MOE nucleoside" means a nucleoside comprising a 2'-MOE modified sugar As used herein, "motif" means the pattern of unmodified and/or modified sugar moieties, nucleobases, and/or internucleoside linkages, in an oligonucleotide.

As used herein, "mRNA" means an RNA transcript that encodes a protein and includes pre-mRNA and mature mRNA unless otherwise specified.

As used herein, "neurodegenerative disease" means a condition marked by progressive loss of structure or function of neurons, including death of neurons. In certain embodiments, the neurodegenerative disease is Parkinson's disease, dementia with Lewy bodies, diffuse Lewy body disease, pure autonomic failure, multiple system atrophy, neuronopathic Gaucher's disease and Alzheimer's disease.

As used herein, "nucleobase" means an unmodified nucleobase or a modified nucleobase. As used herein an "unmodified nucleobase" is adenine (A), thymine (T), cytosine (C), uracil (U), and guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein "prodrug" means a therapeutic agent in a form outside the body that is converted to a different form within an animal or cells thereof. Typically conversion of a prodrug within the animal is facilitated by the action of an enzymes (e.g., endogenous or viral enzyme) or chemicals present in cells or tissues and/or by physiologic conditions.

As used herein, "reducing or inhibiting the amount or activity" refers to a reduction or blockade of the transcriptional expression or activity relative to the transcriptional expression or activity in an untreated or control sample and does not necessarily indicate a total elimination of transcriptional expression or activity.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard cell assay" means the assay described in Example 10 and reasonable variations thereof.

As used herein, "standard in vivo assay" means the experiment described in Example 22 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the results of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) deoxyribosyl moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to an animal. For example, a therapeutically effective amount improves a symptom of a disease.

The present disclosure provides the following non-limiting numbered embodiments:

Embodiment 1. An oligomeric compound comprising a modified oligonucleotide consisting of 10-30 linked nucleosides and having a nucleobase sequence comprising at least 12, 13, 14, 15, 16 or 17 nucleobases of any of SEQ ID NOS: 2193, 1703, 28-1702, 1704-2192, and 2194-2793.

Embodiment 2. An oligomeric compound comprising a modified oligonucleotide consisting of 10-30 linked nucleosides and having a nucleobase sequence complementary to at least 8, at least 9, at least 10, at least 11, at least 12, at least 13, at least 14, at least 15, at least 16, at least 17, at least 18, at least 19, or at least 20 contiguous nucleobases of: an equal length portion of nucleobases 50915-50943 of SEQ ID NO: 2;

an equal length portion of nucleobases 19630-19656 of SEQ ID NO: 2;
an equal length portion of nucleobases 28451-28491 of SEQ ID NO: 2;
an equal length portion of nucleobases 48712-48760 of SEQ ID NO: 2;
an equal length portion of nucleobases 23279-23315 of SEQ ID NO: 2;
an equal length portion of nucleobases 20964-21018 of SEQ ID NO: 2;
an equal length portion of nucleobases 22454-22477 of SEQ ID NO: 2;
an equal length portion of nucleobases 72294-72321 of SEQ ID NO: 2;
an equal length portion of nucleobases 20549-20581 of SEQ ID NO: 2; or
an equal length portion of nucleobases 27412-27432 of SEQ ID NO: 2.

Embodiment 3. The oligomeric compound of embodiment 1 or 2, wherein the modified oligonucleotide has a nucleobase sequence that is at least 80%, 85%, 90%, 95%, or 100% complementary to any of the nucleobase sequences of SEQ ID NO: 1-6, when measured across the entire nucleobase sequence of the modified oligonucleotide.

Embodiment 4. The oligomeric compound of any of embodiments 1-3, wherein the modified oligonucleotide comprises at least one modified nucleoside.

Embodiment 5. The oligomeric compound of embodiment 4, wherein the modified oligonucleotide comprises at least one modified nucleoside comprising a modified sugar moiety.

Embodiment 6. The oligomeric compound of embodiment 5, wherein the modified oligonucleotide comprises at least one modified nucleoside comprising a bicyclic sugar moiety.

Embodiment 7. The oligomeric compound of embodiment 6, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 8. The oligomeric compound of any of embodiments 4-7, wherein the modified oligonucleotide comprises at least one modified nucleoside comprising a non-bicyclic modified sugar moiety.

Embodiment 9. The oligomeric compound of embodiment 8, wherein the modified oligonucleotide comprises at least one modified nucleoside comprising a non-bicyclic modified sugar moiety comprising a 2'-MOE modified sugar or 2'-OMe modified sugar.

Embodiment 10. The oligomeric compound of any of embodiments 4-9, wherein the modified oligonucleotide comprises at least one modified nucleoside comprising a sugar surrogate.

Embodiment 11. The oligomeric compound of embodiment 10, wherein the modified oligonucleotide comprises at least one modified nucleoside comprising a sugar surrogate selected from morpholino and PNA.

Embodiment 12. The oligomeric compound of any of embodiments 1-11, wherein the modified oligonucleotide has a sugar motif comprising:
a 5'-region consisting of 1-5 linked 5'-region nucleosides;
a central region consisting of 6-10 linked central region nucleosides; and
a 3'-region consisting of 1-5 linked 3'-region nucleosides;
wherein
each of the 5'-region nucleosides and each of the 3'-region nucleosides comprises a modified sugar moiety and each of the central region nucleosides comprises an unmodified 2'-deoxyribosyl sugar moiety.

Embodiment 13. The oligomeric compound of any of embodiments 1-12, wherein the modified oligonucleotide comprises at least one modified internucleoside linkage.

Embodiment 14. The oligomeric compound of embodiment 13, wherein each internucleoside linkage of the modified oligonucleotide is a modified internucleoside linkage.

Embodiment 15. The oligomeric compound of embodiment 13 or 14 wherein at least one internucleoside linkage is a phosphorothioate internucleoside linkage.

Embodiment 16. The oligomeric compound of embodiment 13 or 15 wherein the modified oligonucleotide comprises at least one phosphodiester internucleoside linkage.

Embodiment 17. The oligomeric compound of any of embodiments 13, 15, or 16, wherein each internucleoside linkage is either a phosphodiester internucleoside linkage or a phosphorothioate internucleoside linkage.

Embodiment 18. The oligomeric compound of any of embodiments 1-17, wherein the modified oligonucleotide comprises at least one modified nucleobase.

Embodiment 19. The oligomeric compound of embodiment 18, wherein the modified nucleobase is a 5-methyl cytosine.

Embodiment 20. The oligomeric compound of any of embodiments 1-19, wherein the modified oligonucleotide consists of 12-30, 12-22, 12-20, 14-20, 15-25, 16-20, 18-22 or 18-20 linked nucleosides.

Embodiment 21. The oligomeric compound of any of embodiments 1-20, wherein the modified oligonucleotide consists of 17 or 20 linked nucleosides.

Embodiment 22. The oligomeric compound of any of embodiments 1-21 consisting of the modified oligonucleotide.

Embodiment 23. The oligomeric compound of any of embodiments 1-21 comprising a conjugate group comprising a conjugate moiety and a conjugate linker.

Embodiment 24. The oligomeric compound of embodiment 23, wherein the conjugate group comprises a GalNAc cluster comprising 1-3 GalNAc ligands.

Embodiment 25. The oligomeric compound of embodiment 23 or 24, wherein the conjugate linker consists of a single bond.

Embodiment 26. The oligomeric compound of embodiment 24, wherein the conjugate linker is cleavable.

Embodiment 27. The oligomeric compound of embodiment 26, wherein the conjugate linker comprises 1-3 linker-nucleosides.

Embodiment 28. The oligomeric compound of any of embodiments 23-27, wherein the conjugate group is attached to the modified oligonucleotide at the 5'-end of the modified oligonucleotide.

Embodiment 29. The oligomeric compound of any of embodiments 23-27, wherein the conjugate group is attached to the modified oligonucleotide at the 3'-end of the modified oligonucleotide.

Embodiment 30. The oligomeric compound of any of embodiments 1-29 comprising a terminal group.

Embodiment 31. The oligomeric compound of any of embodiments 1-30 wherein the oligomeric compound is a singled-stranded oligomeric compound.

Embodiment 32. The oligomeric compound of any of embodiments 1-26 or 28-30, wherein the oligomeric compound does not comprise linker-nucleosides.

Embodiment 33. An oligomeric duplex comprising an oligomeric compound of any of embodiments 1-30 or 32.

Embodiment 34. An antisense compound comprising or consisting of an oligomeric compound of any of embodiments 1-32 or an oligomeric duplex of embodiment 33.

Embodiment 35. A pharmaceutical composition comprising an oligomeric compound of any of embodiments 1-32 or an oligomeric duplex of embodiment 33 and a pharmaceutically acceptable carrier or diluent.

Embodiment 36. A modified oligonucleotide according to the following formula:

(SEQ ID NO: 1887)
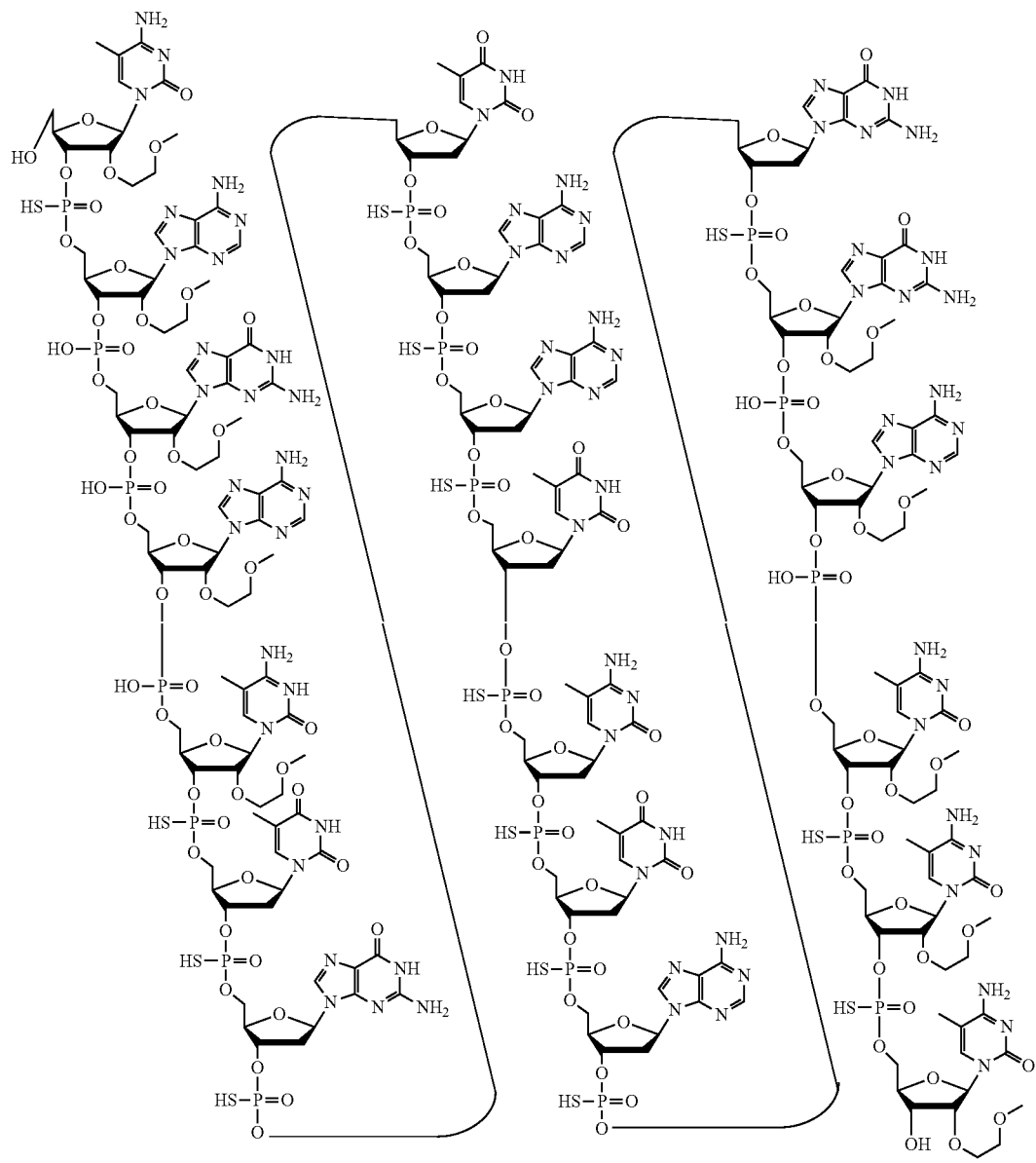
or a salt thereof.
Consistent with the definitions and disclosure herein, compound of Embodiment 36 may be made by deliberately controlling stereochemistry of any, all or none of the linkages.
Embodiment 37. A modified oligonucleotide according to the following formula:

(SEQ ID NO: 2166)
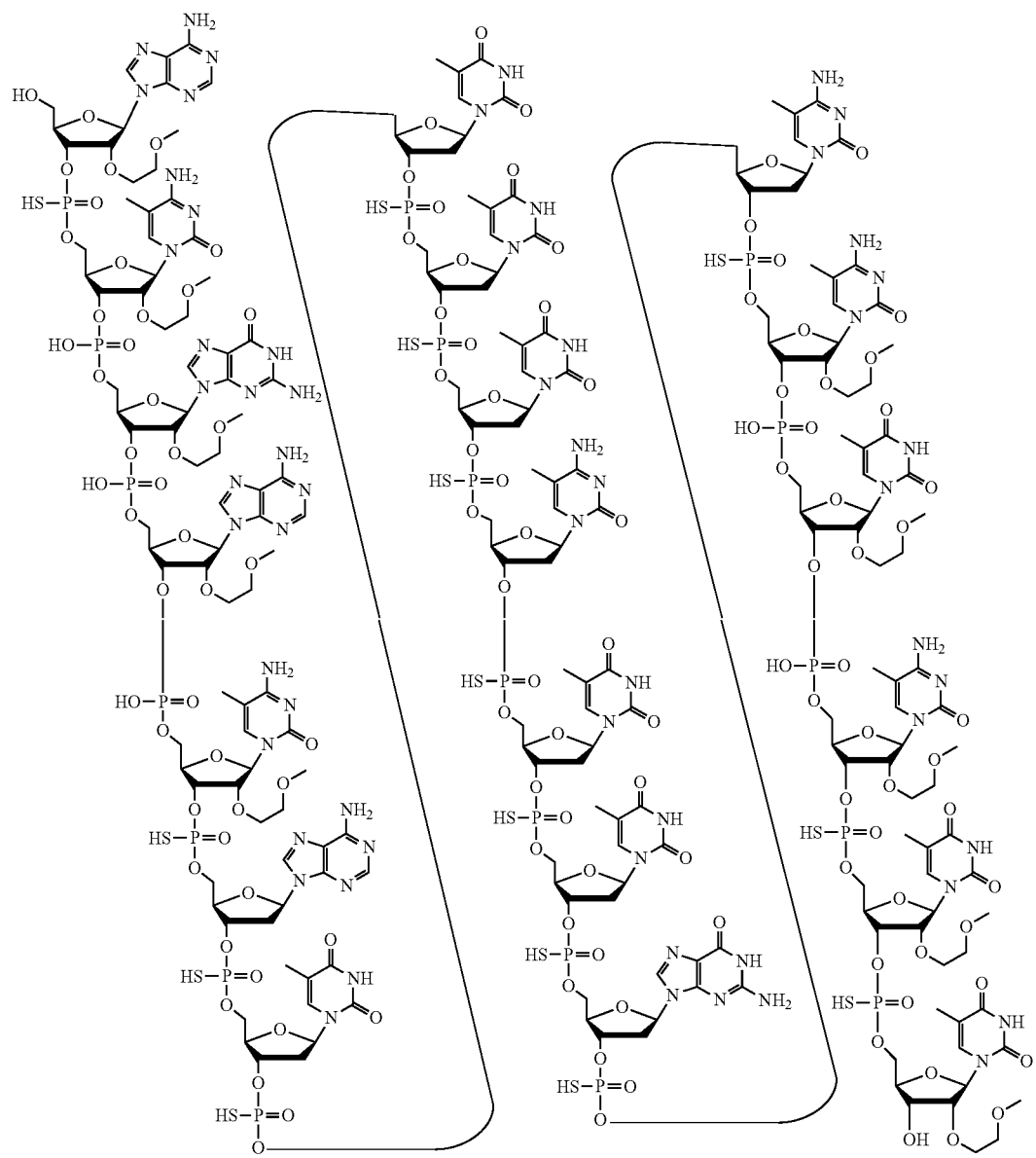
or a salt thereof.
Consistent with the definitions and disclosure herein, compound of Embodiment 37 may be made by deliberately controlling stereochemistry of any, all or none of the linkages.
Embodiment 38. A modified oligonucleotide according to the following formula:

(SEQ ID NO: 2193)
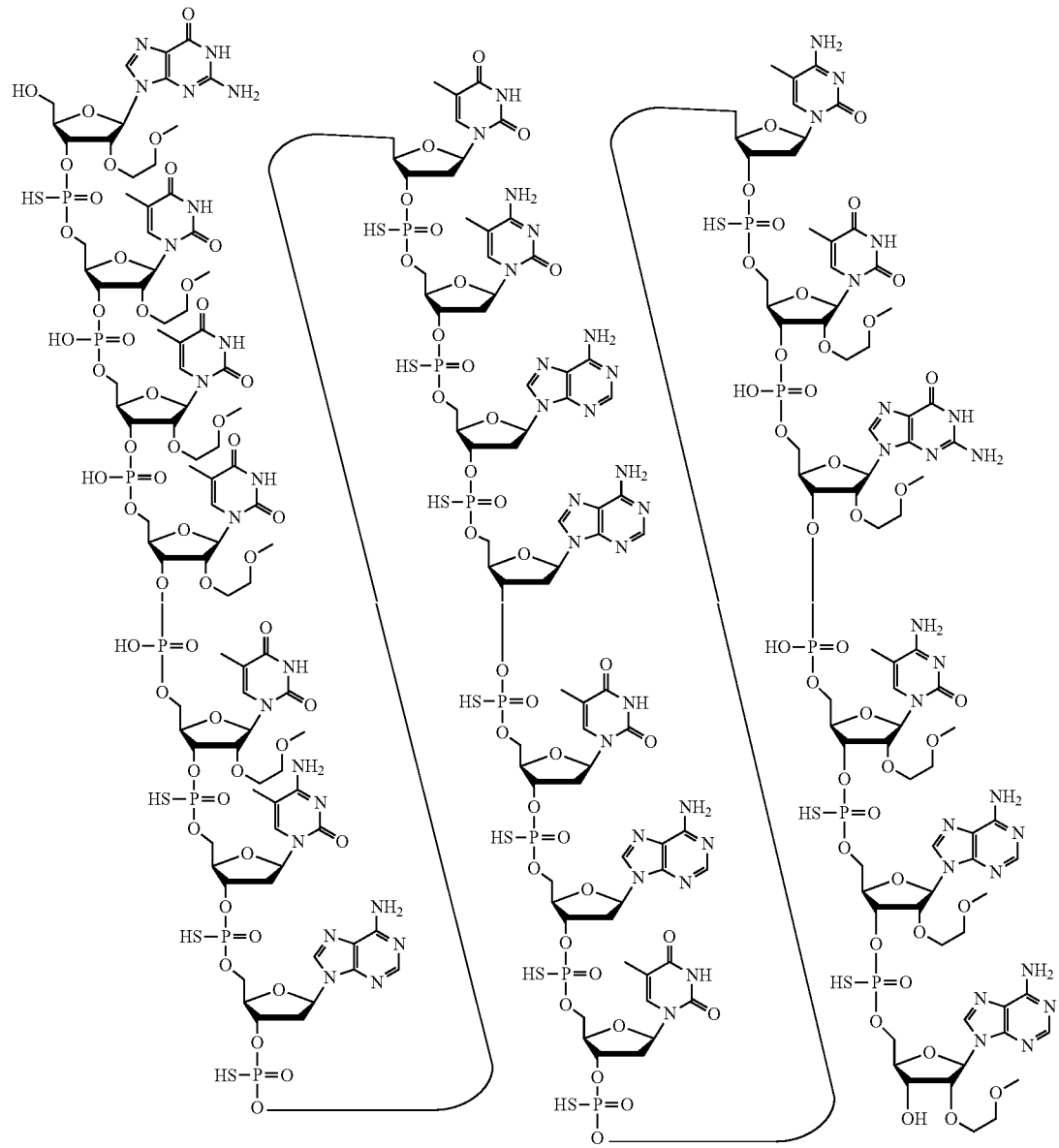
or a salt thereof.
Consistent with the definitions and disclosure herein, compound of Embodiment 38 may be made by deliberately controlly stereochemistry of any, all or none of the linkages.
Embodiment 39. A modified oligonucleotide according to the following formula:

(SEQ ID NO: 1639)
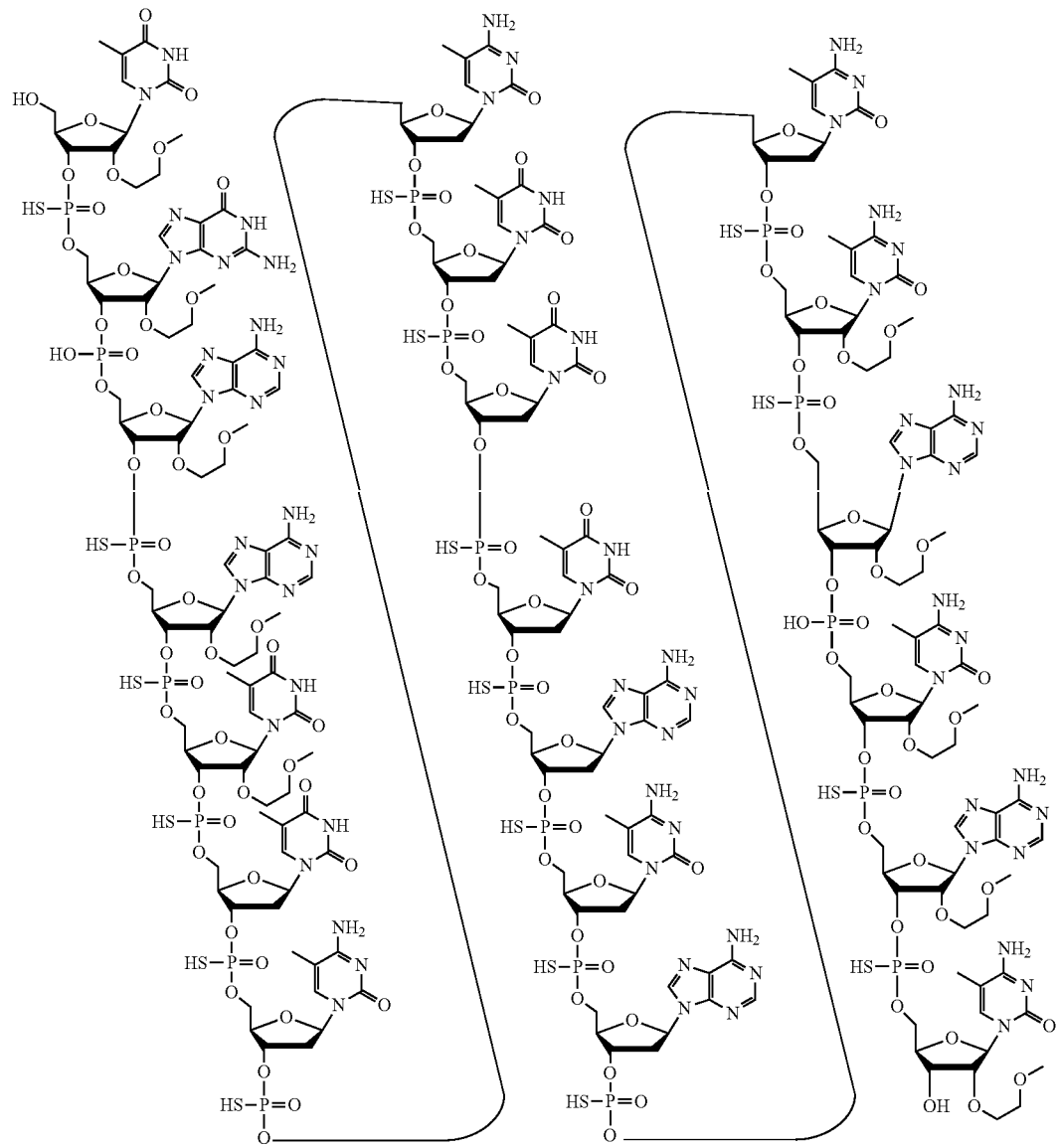
or a salt thereof.
Consistent with the definitions and disclosure herein, compound of Embodiment 39 may be made by deliberately controlling stereochemistry of any, all or none of the linkages.
Embodiment 40. A modified oligonucleotide according to the following formula:

(SEQ ID NO: 1703)
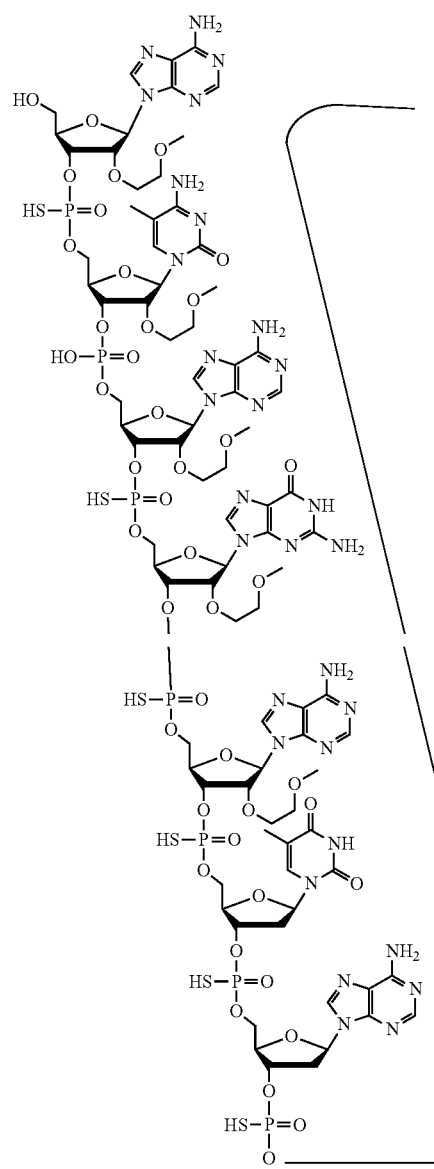
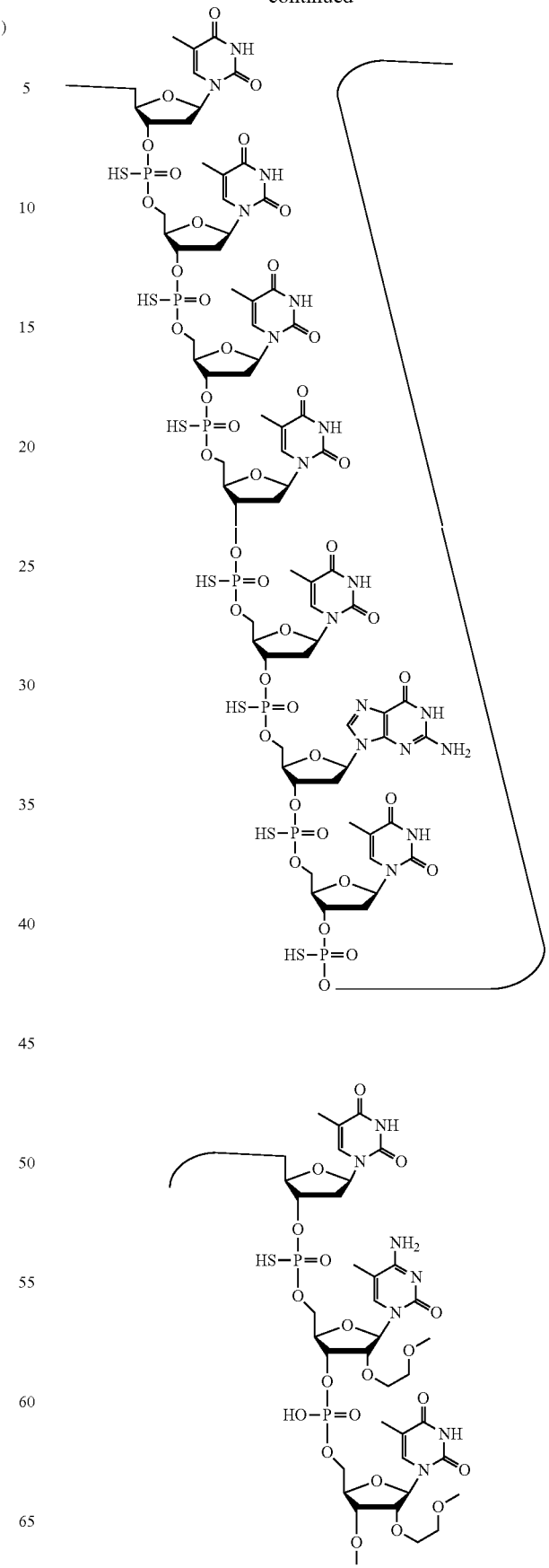

-continued

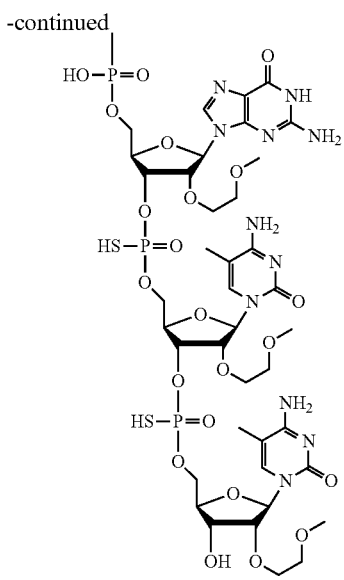

or a salt thereof.

Consistent with the definitions and disclosure herein, compound of Embodiment 40 may be made by deliberately controlling stereochemistry of any, all or none of the linkages.

Embodiment 41. The modified oligonucleotide of any of embodiments 36-40, which is a sodium salt of the formula.

Embodiment 42. A chirally enriched population of the modified oligonucleotide of any of embodiments 36-40 wherein the population is enriched for modified oligonucleotides comprising at least one particular phosphorothioate internucleoside linkage having a particular stereochemical configuration.

Embodiment 43. The chirally enriched population of embodiment 42, wherein the population is enriched for modified oligonucleotides comprising at least one particular phosphorothioate internucleoside linkage having the (Sp) configuration.

Embodiment 44. The chirally enriched population of embodiment 42, wherein the population is enriched for modified oligonucleotides comprising at least one particular phosphorothioate internucleoside linkage having the (Rp) configuration.

Embodiment 45. The chirally enriched population of embodiment 42, wherein the population is enriched for modified oligonucleotides having a particular, independently selected stereochemical configuration at each phosphorothioate internucleoside linkage Embodiment 46. The chirally enriched population of embodiment 45, wherein the population is enriched for modified oligonucleotides having the (Sp) configuration at each phosphorothioate internucleoside linkage.

Embodiment 47. The chirally enriched population of embodiment 45, wherein the population is enriched for modified oligonucleotides having the (Rp) configuration at each phosphorothioate internucleoside linkage.

Embodiment 48. The chirally enriched population of embodiment 45, wherein the population is enriched for modified oligonucleotides having the (Rp) configuration at one particular phosphorothioate internucleoside linkage and the (Sp) configuration at each of the remaining phosphorothioate internucleoside linkages.

Embodiment 48. The chirally enriched population of embodiment 42 or embodiment 45 wherein the population is enriched for modified oligonucleotides having at least 3 contiguous phosphorothioate internucleoside linkages in the Sp, Sp, and Rp configurations, in the 5' to 3' direction.

Embodiment 49. The chirally enriched population of embodiment 42 or embodiment 45 wherein the population is enriched for modified oligonucleotides having at least 3 contiguous phosphorothioate internucleoside linkages in the Sp, Sp, and Rp configurations, in the 5' to 3' direction.

Embodiment 50. A chirally enriched population of oligomeric compounds of any of embodiments 1-32, wherein all of the phosphorothioate internucleoside linkages of the modified oligonucleotide are stereorandom.

Embodiment 51. A pharmaceutical composition comprising the modified oligonucleotide of any of embodiments 36-40 and a pharmaceutically acceptable diluent or carrier.

Embodiment 52. The pharmaceutical composition of embodiment 51, wherein the pharmaceutically acceptable diluent is artificial cerebrospinal fluid.

Embodiment 53. The pharmaceutical composition of embodiment 50, wherein the pharmaceutical composition consists essentially of the modified oligonucleotide and artificial cerebrospinal fluid.

Embodiment 54. A method comprising administering to an animal a pharmaceutical composition of any of embodiments 35 or 51-53.

Embodiment 55. A method of treating a disease associated with SNCA comprising administering to an individual having or at risk for developing a disease associated with SNCA a therapeutically effective amount of a pharmaceutical composition according to any of embodiments 35 or 51-53; and thereby treating the disease associated with SNCA.

Embodiment 56. The method of embodiment 55, wherein the disease associated with SNCA is a neurodegenerative disease.

Embodiment 57. The method of embodiment 56, wherein the neurodegenerative disease is any of Parkinson's disease, dementia with Lewy bodies, diffuse Lewy body disease, pure autonomic failure, multiple system atrophy, neuronopathic Gaucher's disease and Alzheimer's disease.

Embodiment 58. The method of embodiment 56, wherein at least one symptom or hallmark of the neurodegenerative disease is ameliorated.

Embodiment 59. The method of embodiment 58, wherein the symptom or hallmark is any of motor dysfunction, aggregation of alpha-synuclein, neurodegeneration, cognitive decline and dementia.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modifed sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$O CH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)- alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.).

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$O N(R$_m$)(R$_n$), O(CH$_2$)$_2$O(CH$_2$)$_2$N(CH$_3$)$_2$, and N-substituted acetamide (OCH$_2$C(=O)—N(R.)(R.)), where each R$_m$ and R$_n$ is, independently, H, an amino protecting group, or substituted or unsubstituted C$_1$-C$_{10}$ alkyl.

In certain embodiments, a 2'-substituted nucleoside non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$O N(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted non-bicyclic modified nucleoside comprises a sugar moiety comprising a non-bridging 2'-substituent group selected from: F, OCH$_3$, and OCH$_2$CH$_2$OCH$_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'—(CH$_2$)$_2$-2', 4'—(CH$_2$)$_3$-2', 4'—CH$_2$—O-2' ("LNA"), 4'-CH$_2$—S-2', 4'—(CH$_2$)$_2$—O-2' ("ENA"), 4'-CH(CH$_3$)—O-2' (referred to as "constrained ethyl" or "cEt"), 4'-CH$_2$—O—CH$_2$-2', 4'—CH$_2$—N(R)-2', 4'—CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., J. Org. Chem., 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'—C(R$_a$R$_b$)—O—N(R)-2', 4'—CH$_2$—O—N(R)-2', and 4'-CH$_2$—N(R)—O-2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, [C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 20017, 129, 8362-8379; Wengel e a., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794, 499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

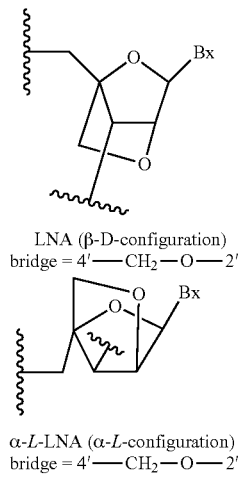

LNA (β-D-configuration)
bridge = 4'——CH$_2$—O——2'

α-L-LNA (α-L-configuration)
bridge = 4'——CH$_2$—O——2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

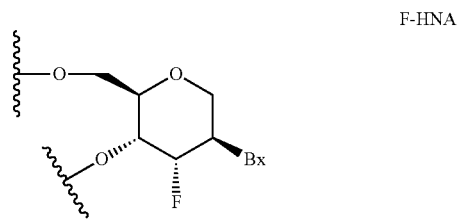

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

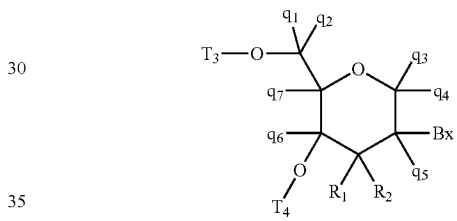

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom.

For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

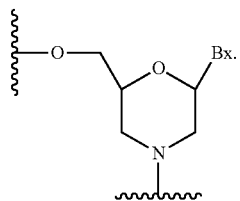

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieites. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides).

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp)

Modified nucleobases may also include those in which the purine or pyrimidine base is replaced with other heterocycles, for example 7-deazaadenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie, International Edition*, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manohara et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

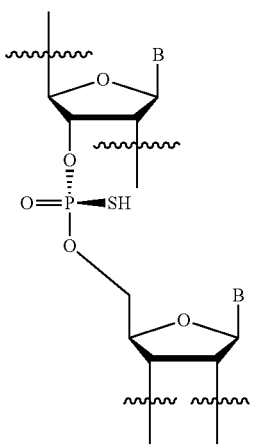

(Rp)

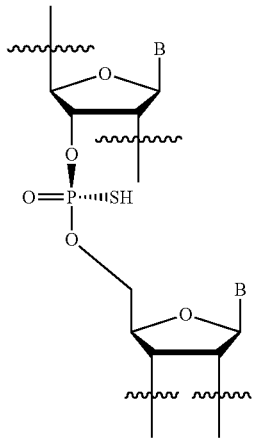

(Sp)

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—N($CH_3$)—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl, and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, each nucleoside of each wing of a gapmer is a modified nucleoside. In certain embodiments, at least one nucleoside of each wing of a gapmer is a modified nucleoside. In certain embodiments, at least two nucleosides of each wing of a gapmer are modified nucleosides. In certain embodiments, at least three nucleosides of each wing of a gapmer are modified nucleosides. In certain embodiments, at least four nucleosides of each wing of a gapmer are modified nucleosides.

In certain embodiments, the gap of a gapmer comprises 7-12 nucleosides. In certain embodiments, each nucleoside of the gap of a gapmer is an unmodified 2'-deoxy nucleoside.

In certain embodiments, the gapmer is a deoxy gapmer. In embodiments, the nucleosides on the gap side of each wing/gap junction are unmodified 2'-deoxy nucleosides and the nucleosides on the wing sides of each wing/gap junction are modified nucleosides. In certain embodiments, each nucleoside of the gap is an unmodified 2'-deoxy nucleoside. In certain embodiments, each nucleoside of each wing of a gapmer is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]–[# of nucleosides in the gap]–[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprise unmodified deoxynucleosides sugars. Thus, a 5-10-5 MOE gapmer consists of 5 linked MOE modified nucleosides in the 5'-wing, 10 linked deoxynucleosides in the gap, and 5 linked MOE nucleosides in the 3'-wing.

In certain embodiments, modified oligonucleotides are 5-10-5 MOE gapmers. In certain embodiments, modified oligonucleotides are 3-10-3 BNA gapmers. In certain embodiments, modified oligonucleotides are 3-10-3 cEt gapmers. In certain embodiments, modified oligonucleotides are 3-10-3 LNA gapmers.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target mRNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides D. Certain Modified Oligonucleotides In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., *Proc. Natl. Acad. Sci. USA*, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e g., do-decan-diol or undecyl residues (Saison-Behmoaras et al., *EMBO J.*, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

B. Certain Terminal Groups

In certain embodiments, oligomeric compounds comprise one or more terminal groups. In certain such embodiments, oligomeric compounds comprise a stabilized 5'-phophate. Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a region complementary to a target nucleic acid and a second oligomeric compound having a region complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or animal.

V. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and a 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. SNCA

In certain embodiments, oligomeric compounds comprise or consist of an oligonucleotide comprising a region that is complementary to a target nucleic acid, wherein the target nucleic acid is SNCA. In certain embodiments, SNCA nucleic acid has the sequence set forth in SEQ ID NO: 1 (GENBANK Accession No: NM_000345.3), SEQ ID NO: 2 (GENBANK Accession No: NT_016354.20 TRUNC 30800000-30919000), SEQ ID NO: 3 (GENBANK Accession No: JN709863.1), SEQ ID NO: 4 (GENBANK Accession No: BC013293.2), SEQ ID NO: 5 (GENBANK Accession No: NM_001146055.1), and SEQ ID NO: 6 (GENBANK Accession No: HQ830269.1).

In certain embodiments, contacting a cell with an oligomeric compound complementary to SEQ ID NO: 1, SEQ ID NO: 2, SEQ ID NO: 3, SEQ ID NO: 4, SEQ ID NO: 5, or SEQ ID NO: 6 reduces the amount of SNCA mRNA, and in certain embodiments reduces the amount of alpha-synuclein protein. In certain embodiments, the oligomeric compound consists of a modified oligonucleotide. In certain embodiments, contacting a cell in an animal with an oligomeric compound complementary to SEQ ID NO: 1, SEQ ID NO: 2, SEQ ID NO: 3, SEQ ID NO: 4, SEQ ID NO: 5, or SEQ ID NO: 6 ameliorates one or more symptom or hallmark of a neurodegenerative disease. In certain embodiments, the oligomeric compound consists of a modified oligonucleotide. In certain embodiments, the symptom or hallmark is motor dysfunction, aggregation of alpha-synuclein, neurodegeneration, cognitive decline and dementia. In certain embodiments, contacting a cell in an animal with an oligonucleotide complementary to SEQ ID NO: 1, SEQ ID NO: 2, SEQ ID NO: 3, SEQ ID NO: 4, SEQ ID NO: 5, or SEQ ID NO: 6 results in improved motor function, reduction of alpha-synuclein aggregates, reduced neurodegeneration and/or reduced dementia. In certain embodiments, the oligomeric compound consists of a modified oligonucleotide

C. Certain Tart et Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system (CNS). Such cells and tissues include motor cortex, frontal cortex, caudate, amygdala, pons, substantia nigra, putamen, cerebellar peduncle, corpus collosum, dorsal cochlear nucleus (DCN), entorhinal cortex (Ent Cortex), hippocampus, insular cortex, medulla oblongata, central gray matter, pulvinar, occipital cortex, cerebral cortex, temporal cortex, globus pallidus, superior colliculi, and basal forbrain nuclei.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may contain.

VII. Certain Compositions

1. Compound No: 763085

In certain embodiments, Compound No: 763085 is characterized as a 5-10-5 MOE gapmer, having a sequence of (from 5' to 3') CAGACTGTAATCTAGGACCC (incorporated herein as SEQ ID NO: 1887), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No: 763085 is characterized by the following chemical notation: mCes Aeo Geo Aeo mCes Tds Gds Tds Ads Ads Tds mCds Tds Ads Gds Geo Aeo mCes mCes mCe; wherein, A=an adenine nucleobase, mC=a 5-methyl cytosine nucleobase, G=a guanine nucleobase, T=a thymine nucleobase, e=a 2'-MOE modified sugar, d=a 2'-deoxyribose sugar, s=a phosphorothioate internucleoside linkage, and o=a phosphodiester internucleoside linkage.

In certain embodiments, Compound No: 763085 is represented by the following chemical structure:

Structure 1. Compound No. 763085

(SEQ ID NO: 1887)

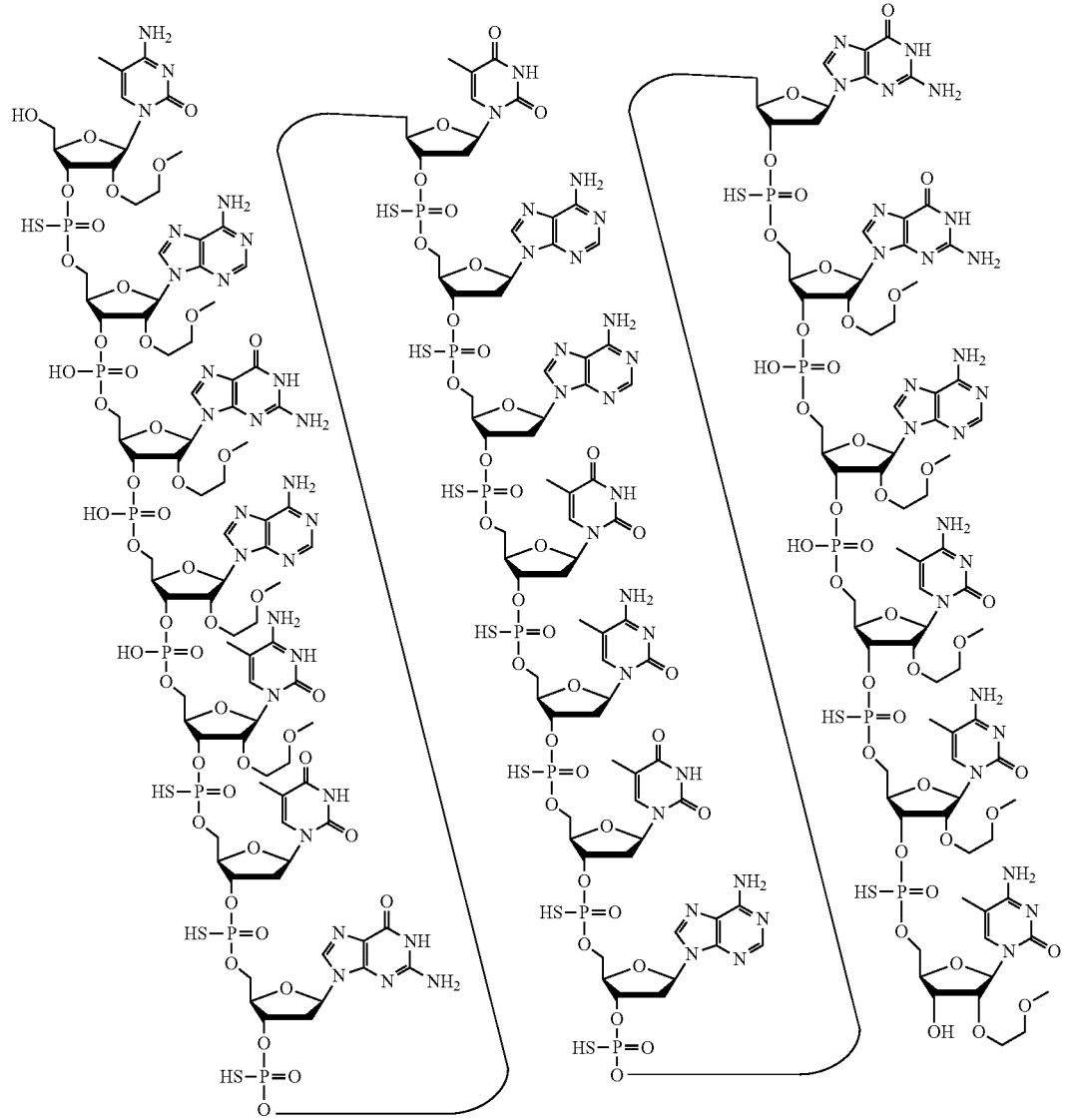

2. Compound No: 763364

In certain embodiments, Compound No: 763364 is characterized as a 5-10-5 MOE gapmer, having a sequence of (from 5' to 3') ACGACATTTTCTTGCCTCTT (incorporated herein as SEQ ID NO: 2166), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No: 763364 is characterized by the following chemical notation: Aes mCeo Geo Aeo mCes Ads Tds Tds Tds Tds mCds Tds Tds Gds mCds mCeo Teo mCes Tes Te; wherein, A=an adenine nucleobase, mC=a 5-methyl cytosine nucleobase, G=a guanine nucleobase, T=a thymine nucleobase, e=a 2'-MOE modified sugar, d=a 2'-deoxyribose sugar, s=a phosphorothioate internucleoside linkage, and o=a phosphodiester internucleoside linkage.

In certain embodiments, Compound No: 763364 is represented by the following chemical structure:

Structure 2. Compound No: 763364

(SEQ ID NO: 2166)

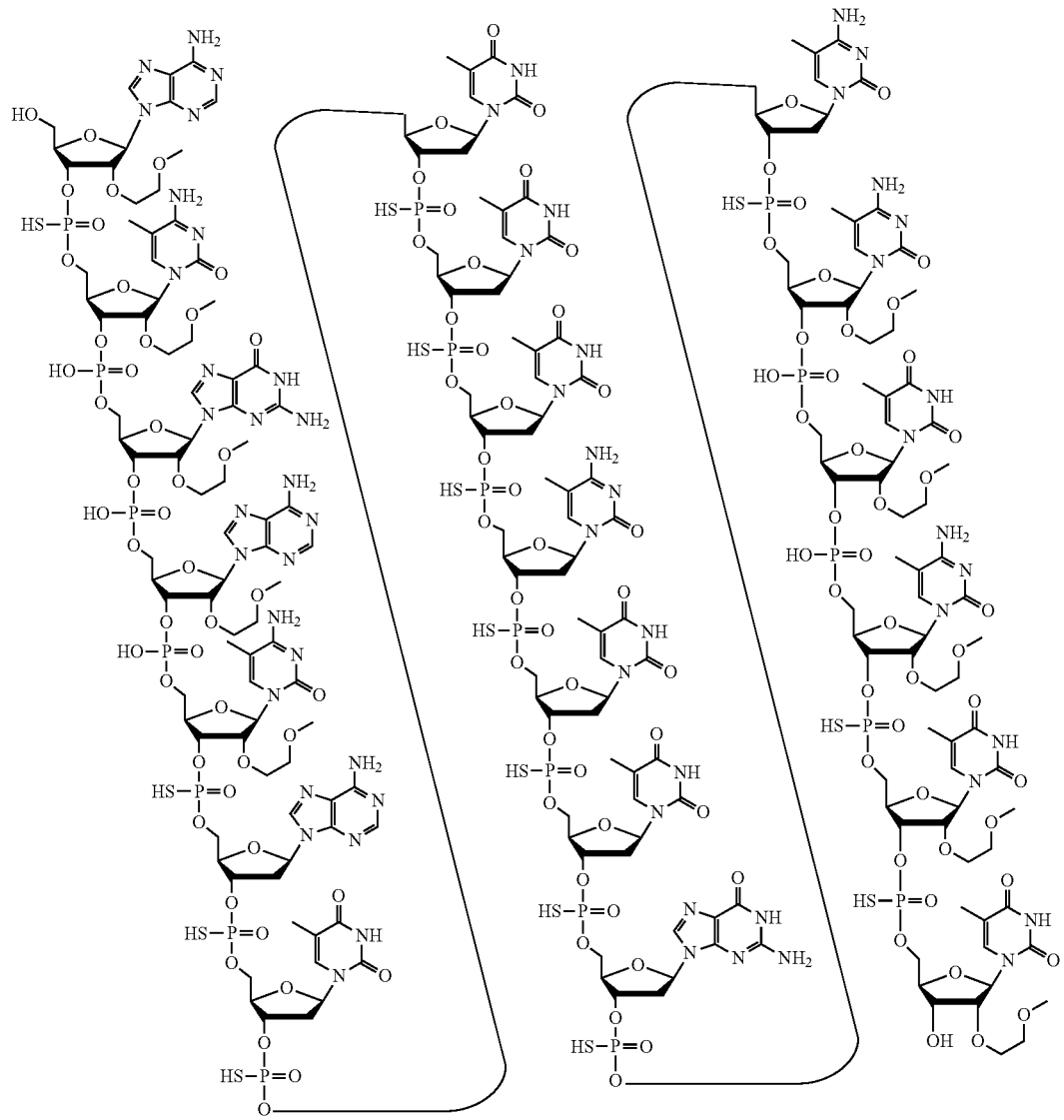

3. Compound No: 763391

In certain embodiments, Compound No: 763391 is characterized as a 5-10-5 MOE gapmer, having a sequence of (from 5' to 3') GTTTTCATCAATATCTGCAA (incorporated herein as SEQ ID NO: 2193), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No: 763391 is characterized by the following chemical notation: Ges Teo Teo Teo Tes mCds Ads Tds mCds Ads Ads Tds Ads Tds mCds Teo Geo mCes Aes Ae; wherein, A=an adenine nucleobase, mC=a 5-methyl cytosine nucleobase, G=a guanine nucleobase, T=a thymine nucleobase, e=a 2'-MOE modified sugar, d=a 2'-deoxyribose sugar, s=a phosphorothioate internucleoside linkage, and o=a phosphodiester internucleoside linkage.

In certain embodiments, Compound No: 763391 is represented by the following chemical structure:

Structure 3. Compound No: 763391

(SEQ ID NO: 2193)

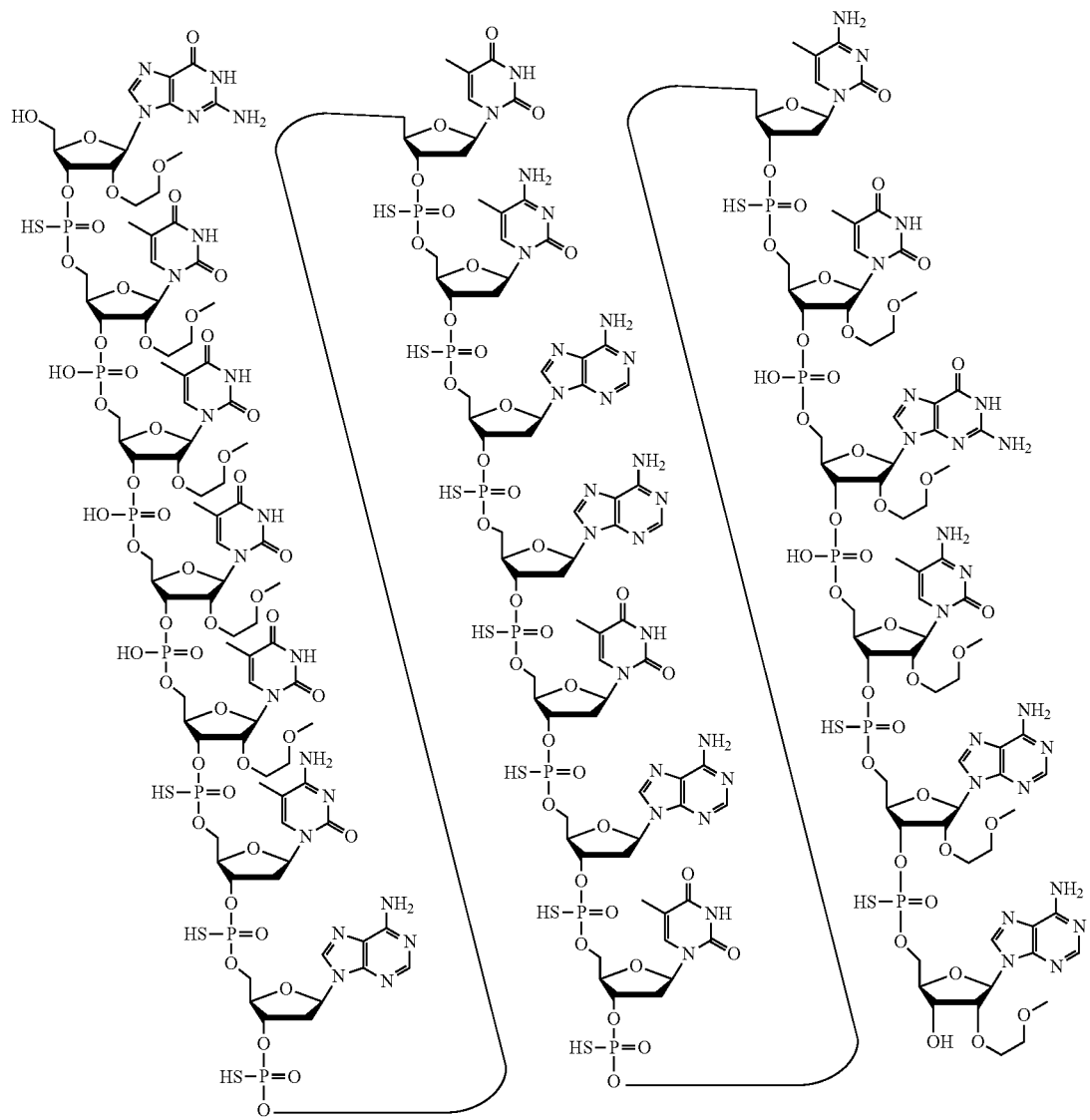

4. Compound No: 789243

In certain embodiments, Compound No: 789243 is characterized as a 5-10-5 MOE gapmer, having a sequence of (from 5' to 3') TGAATTCCTTTACACCACAC (incorporated herein as SEQ ID NO: 1639), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3 and 17 to 18 are phosphodiester internucleoside linkages and the internucleoside linkages between nucleosides 1 to 2, 3 to 4, 4 to 5, 5 to 6, 6 to 7, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No: 789243 is characterized by the following chemical notation: Tes Geo Aes Aes Tes Tds mCds mCds Tds Tds Tds Ads mCds Ads mCds mCes Aeo mCes Aes mCe; wherein, A=an adenine nucleobase, mC=a 5-methyl cytosine nucleobase, G=a guanine nucleobase, T=a thymine nucleobase, e=a 2'-MOE modified sugar, d=a 2'-deoxyribose sugar, s=a phosphorothioate internucleoside linkage, and o=a phosphodiester internucleoside linkage.

In certain embodiments, Compound No: 789243 is represented by the following chemical structure:

Structure 4. Compound No: 789243
(SEQ ID NO: 1639)

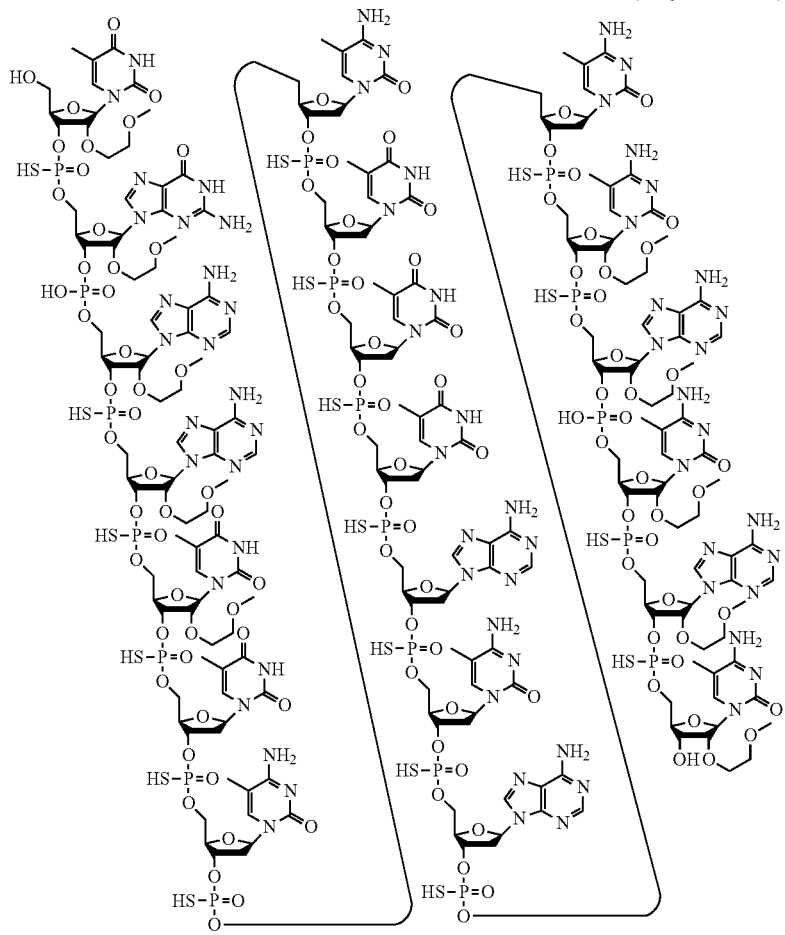

5. Compound No: 827599

In certain embodiments, Compound No: 827599 is characterized as a 5-10-5 MOE gapmer, having a sequence of (from 5' to 3') ACAGATATTTTTGTTCTGCC (incorporated herein as SEQ ID NO: 1703), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 16 to 17, and 17 to 18 are phosphodiester internucleoside linkages and the internucleoside linkages between nucleosides 1 to 2, 3 to 4, 4 to 5, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No: 827599 is characterized by the following chemical notation: Aes mCeo Aes Ges Aes Tds Ads Tds Tds Tds Tds Tds Gds Tds Tds mCeo Teo Ges mCes mCe; wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

In certain embodiments, Compound No: 827599 is represented by the following chemical structure:

Structure 5. Compound No: 827599

(SEQ ID NO: 1703)

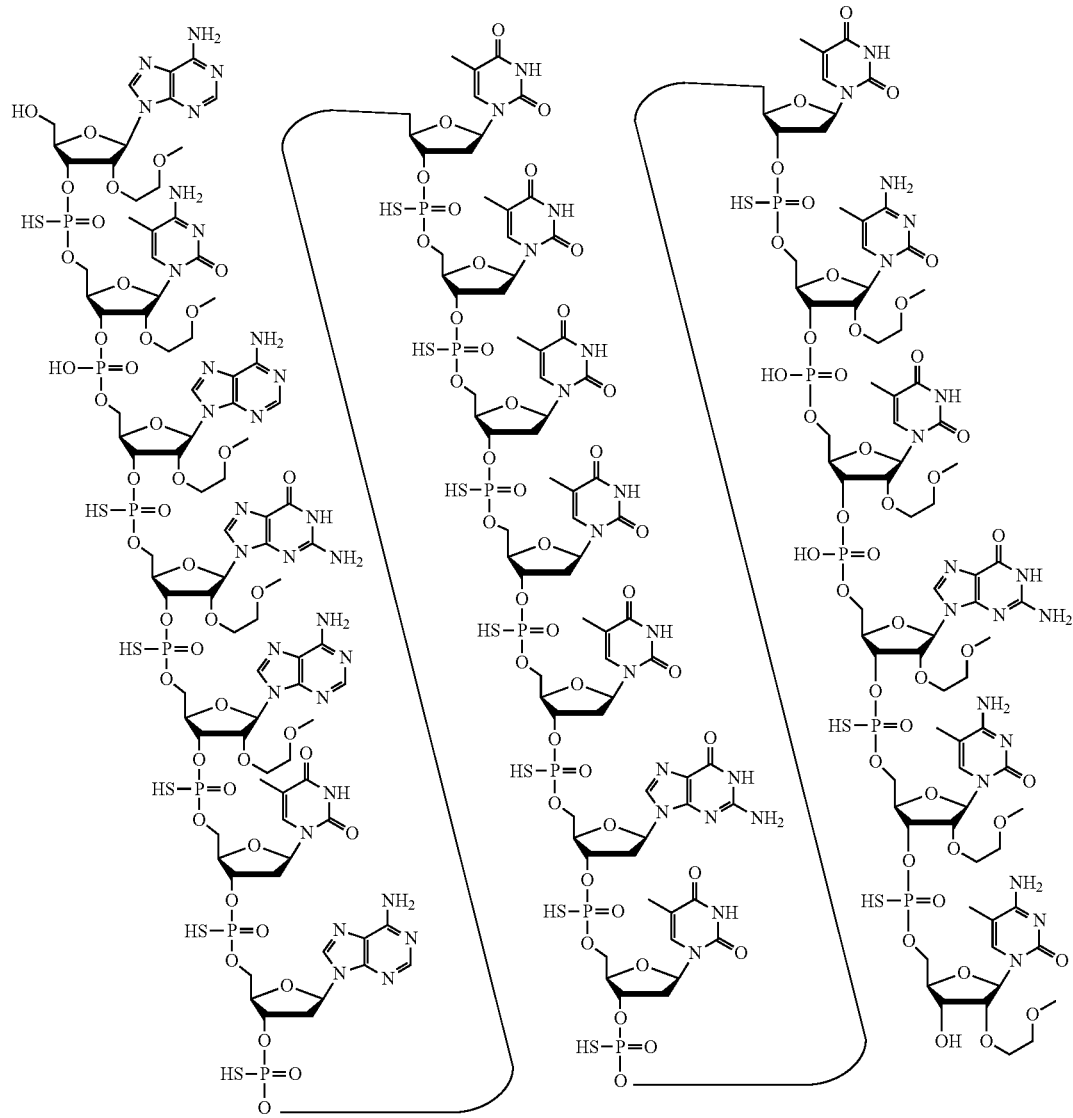

VIII. Certain Comparator Compositions

In certain embodiments, Compound No: 387978, a 5-10-5 MOE gapmer, having a sequence of (from 5' to 3') TCCTTGGCCTTTGAAAGTCC (incorporated herein as SEQ ID NO: 21), wherein each internucleoside linkage is a phorsphorothioate internucleoside linkage, each cytosine is a 5-methyl cytosine, and each of nucleosides 1-5 and 16-20 (from 5' to 3') comprise a 2'-MOE modified sugar, which was previously described in WO 2012/068405, incorporated herein by reference, is a comparator compound. Compound No. 387978 was selected as a comparator compound because it was potent in multiple dose studies of reducing human SNCA mRNA without overt toxicity in various studies as described in WO 2012/068405. Thus, based on the disclosure of WO 2012/068405, Compound No. 387978 was deemed potent with an acceptable tolerability profile.

In certain embodiments, Compound No: 387985, a 5-10-5 MOE gapmer, having a sequence of (from 5' to 3') CCAA-CATTTGTCACTTGCTC (incorporated herein as SEQ ID NO: 22), wherein each internucleoside linkage is a phorsphorothioate internucleoside linkage, each cytosine is a 5-methyl cytosine, and each of nucleosides 1-5 and 16-20 (from 5' to 3') comprise a 2'-MOE modified sugar, which was previously described in WO 2012/068405, incorporated herein by reference, is a comparator compound. Compound No. 387985 was selected as a comparator compound because it was potent in multiple dose studies of reducing human SNCA mRNA without overt toxicity in various studies as described in WO 2012/068405. Thus, based on the disclosure of WO 2012/068405, Compound No. 387985 was deemed potent with an acceptable tolerability profile.

In certain embodiments, compounds described herein are superior relative to the compounds described in WO 2012/

068405 because they demonstrate one or more improved properties, such as, potency and tolerability.

Compound 763085

For example, as provided in Example 10 (hereinbelow), Compound 763085 demonstrated an $IC_{50}$ of <0.44 µM in SHSH-SY5Y cells when tested at concentrations of 0.44 µM, 1.33 µM, 4.00 µM and 12.00 µM. Comparator Compound 387985 demonstrated an $IC_{50}$ of 5.00 µM in the same study. Therefore, Compound 763085 is demonstrably more potent than Comparator Compound 387985 in this assay.

For example, as provided in Example 11 (hereinbelow), Compound 763085 demonstrated an $IC_{50}$ of 0.47 µM in SHSH-SY5Y cells when tested at concentrations of 0.032 µM, 0.160 µM, 0.800 µM, 4.000 µM and 20.000 µM. Comparator Compound 387985 demonstrated an $IC_{50}$ of 4.20 µM in the same study. Therefore, Compound 763085 is demonstrably more potent than Comparator Compound 387985 in this assay.

For example, as provided in Example 17 (hereinbelow), Compound 763085 demonstrated functional observational battery (FOB) scores of 0.8 and 1.3 whereas Comparator Compound 387985 demonstrated a FOB score of 6.0 in wild-type C57/B16 mice after 3 hours when treated with 700 µg of oligonucleotide by ICV administration. Therefore, Compound 763085 is demonstrably more tolerable than Comparator Compound 387985 in this assay.

Compound 763364

For example, as provided in Example 10 (hereinbelow), Compound 763364 demonstrated an $IC_{50}$ of <0.44 µM in SHSH-SY5Y cells when tested at concentrations of 0.44 µM, 1.33 µM, 4.00 µM and 12.00 µM. Comparator Compound 387985 demonstrated an $IC_{50}$ of 5.00 µM in the same study. Therefore, Compound 763364 is demonstrably more potent than Comparator Compound 387985 in this assay.

For example, as provided in Example 11 (hereinbelow), Compound 763364 demonstrated an $IC_{50}$ of 0.86 µM in SHSH-SY5Y cells when tested at concentrations of 0.032 µM, 0.160 µM, 0.800 µM, 4.000 µM and 20.000 µM. Comparator Compound 387985 demonstrated an $IC_{50}$ of 4.20 µM in the same study. Therefore, Compound 763364 is demonstrably more potent than Comparator Compound 387985 in this assay.

Compound 763391

For example, as provided in Example 10 (hereinbelow), Compound 763391 demonstrated an $IC_{50}$ of 0.94 µM and 2.49 µM in SHSH-SY5Y cells when tested at concentrations of 0.44 µM, 1.33 µM, 4.00 µM and 12.00 µM. Comparator Compound 387985 demonstrated an $IC_{50}$ of 5.00 µM in the same study. Therefore, Compound 763391 is demonstrably more potent than Comparator Compound 387985 in this assay.

For example, as provided in Example 11 (hereinbelow), Compound 763391 demonstrated an $IC_{50}$ of 1.10 µM in SHSH-SY5Y cells when tested at concentrations of 0.032 µM, 0.160 µM, 0.800 µM, 4.000 µM and 20.000 µM. Comparator Compound 387985 demonstrated an $IC_{50}$ of 4.20 µM in the same study. Therefore, Compound 763391 is demonstrably more potent than Comparator Compound 387985 in this assay.

For example, as provided in Example 17 (hereinbelow), Compound 763391 demonstrated a FOB score of 0.0 and 2.3 whereas Comparator Compound 387985 demonstrated a FOB score of 6.0 in wild-type C57/B16 mice after 3 hours when treated with 700 µg of oligonucleotide by ICV administration. Therefore, Compound 763391 is demonstrably more tolerable than Comparator Compound 387985 in this assay.

For example, as provided in Example 18 (hereinbelow), Compound 763391 demonstrated FOB scores of 0.0 and 1.3 whereas Comparator Compound 387985 demonstrated a FOB score of 3.8 in Sprague Dawley rats after 3 hours when treated with 3 mg of oligonucleotide by IT administration. Therefore, Compound 763391 is demonstrably more tolerable than Comparator Compound 387985 in this assay.

Compound 789243

For example, as provided in Example 10 (hereinbelow), Compound 789243 demonstrated an $IC_{50}$ of 2.40 µM in SHSH-SY5Y cells when tested at concentrations of 0.44 µM, 1.33 µM, 4.00 µM and 12.00 µM. Comparator Compound 387985 demonstrated an $IC_{50}$ of 5.00 µM in the same study. Therefore, Compound 789243 is demonstrably more potent than Comparator Compound 387985 in this assay.

For example, as provided in Example 11 (hereinbelow), Compound 789243 demonstrated an $IC_{50}$ of 2.25 µM and 1.90 µM in SHSH-SY5Y cells when tested at concentrations of 0.032 µM, 0.160 µM, 0.800 µM, 4.000 µM and 20.000 µM. Comparator Compound 387985 demonstrated an $IC_{50}$ of 4.20 µM in the same study. Therefore, Compound 789243 is demonstrably more potent than Comparator Compound 387985 in this assay.

For example, as provided in Example 17 (hereinbelow), Compound 789243 demonstrated a FOB score of 0.3 and 0.0 whereas Comparator Compound 387985 demonstrated a FOB score of 6.0 in wild-type C57/B16 mice after 3 hours when treated with 700 µg of oligonucleotide by ICV administration. Therefore, Compound 789243 is demonstrably more tolerable than Comparator Compound 387985 in this assay.

For example, as provided in Example 18 (hereinbelow), Compound 789243 demonstrated FOB scores of 1.8 and 1.5 whereas Comparator Compound 387985 demonstrated a FOB score of 3.8 in Sprague Dawley rats after 3 hours when treated with 3 mg of oligonucleotide by IT administration. Therefore, Compound 789243 is demonstrably more tolerable than Comparator Compound 387985 in this assay.

Compound 827599

For example, as provided in Example 10 (hereinbelow), Compound 827599 demonstrated an $IC_{50}$ of 0.40 µM µM in SHSH-SY5Y cells when tested at concentrations of 0.44 µM, 1.33 µM, 4.00 µM and 12.00 µM. Comparator Compound 387985 demonstrated an $IC_{50}$ of 5.00 µM in the same study. Therefore, Compound 827599 is demonstrably more potent than Comparator Compound 387985 in this assay.

For example, as provided in Example 11 (hereinbelow), Compound 827599 demonstrated an $IC_{50}$ of 0.40 µM in SHSH-SY5Y cells when tested at concentrations of 0.032 µM, 0.160 µM, 0.800 µM, 4.000 µM and 20.000 µM. Comparator Compound 387985 demonstrated an $IC_{50}$ of 4.20 µM in the same study. Therefore, Compound 827599 is demonstrably more potent than Comparator Compound 387985 in this assay.

For example, as provided in Example 17 (hereinbelow), Compound 827599 demonstrated a FOB score of 0.0 whereas Comparator Compound 387985 demonstrated a FOB score of 6.0 in wild-type C57/B16 mice after 3 hours when treated with 700 µg of oligonucleotide by ICV administration. Therefore, Compound 827599 is demonstrably more tolerable than Comparator Compound 387985 in this assay.

For example, as provided in Example 18 (hereinbelow), Compound 827599 demonstrated a FOB score of 2.0 whereas Comparator Compound 387985 demonstrated a FOB score of 3.8 in Sprague Dawley rats after 3 hours when treated with 3 mg of oligonucleotide by IT administration. Therefore, Compound 827599 is demonstrably more tolerable than Comparator Compound 387985 in this assay.

IX. Certain Hotspot Regions

1. Nucleobases 50915-50943 of SEQ ID NO: 2

In certain embodiments, nucleobases 50915-50943 of SEQ ID NO: 2 comprise a hotspot region. In certain embodiments, modified oligonucleotides are complementary to nucleobases 50915-50943 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the internucleoside linkages of the modified oligonucleotides are phosphorothioate internucleoside linkages and phosphodiester internucleoside linkages.

The nucleobase sequences of SEQ ID Nos: 243, 1601-1603, and 2188, 2189, 2190, 2191, 2192, 2193, 2194, 2195, 2196 and 2197 are complementary to nucleobases 50915-50943 of SEQ ID NO: 2.

In certain embodiments, modified oligonucleotides complementary to nucleobases 50915-50943 of SEQ ID NO: 2 achieve at least 45% reduction of SNCA RNA in vitro in the standard cell assay.

2. Nucleobases 19630-19656 of SEQ ID NO: 2

In certain embodiments, nucleobases 19630-19656 of SEQ ID NO: 2 comprise a hotspot region. In certain embodiments, modified oligonucleotides are complementary to nucleobases 19630-19656 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 1103, 1700, 1701, 1702, 1703, 1704, 1705, 1706 and 1707 are complementary to nucleobases 19630-19656 of SEQ ID NO: 2.

In certain embodiments, modified oligonucleotides complementary to nucleobases 19630-19656 of SEQ ID NO: 2 achieve at least 48% reduction of SNCA RNA in vitro in the standard cell assay.

3. Nucleobases 28451-28491 of SEQ ID NO: 2

In certain embodiments, nucleobases 28451-28491 of SEQ ID NO: 2 comprise a hotspot region. In certain embodiments, modified oligonucleotides are complementary to nucleobases 28451-28491 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 1168, 1882, 1883, 1884, 1885, 1886, 1887, 1888, 1889, 1890, 1891, 1892 and 1893 are complementary to nucleobases 28451-28491 of SEQ ID NO: 2.

In certain embodiments, modified oligonucleotides complementary to nucleobases 28451-28491 of SEQ ID NO: 2 achieve at least 47% reduction of SNCA RNA in vitro in the standard cell assay.

4. Nucleobases 48712-48760 of SEQ ID NO:2

In certain embodiments, nucleobases 48712-48760 of SEQ ID NO: 2 comprise a hotspot region. In certain embodiments, modified oligonucleotides are complementary to nucleobases 48712-48760 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 471, 1585-1588, and 2157-2166 are complementary to nucleobases 48712-48760 of SEQ ID NO: 2.

In certain embodiments, modified oligonucleotides complementary to nucleobases 48712-48760 of SEQ ID NO: 2 achieve at least 40% reduction of SNCA RNA in vitro in the standard cell assay.

5. Nucleobases 23279-23315 of SEQ ID NO: 2

In certain embodiments, nucleobases 23279-23315 of SEQ ID NO: 2 comprise a hotspot region. In certain embodiments, modified oligonucleotides are complementary to nucleobases 23279-23315 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 164, 1130-1133, and 1797-1810 are complementary to nucleobases 23279-23315 of SEQ ID NO: 2.

In certain embodiments, modified oligonucleotides complementary to nucleobases 23279-23315 of SEQ ID NO: 2 achieve at least 57% reduction of SNCA RNA in vitro in the standard cell assay.

6. Nucleobases 20964-21018 of SEQ ID NO: 2

In certain embodiments, nucleobases 20964-21018 of SEQ ID NO: 2 comprise a hotspot region. In certain embodiments, modified oligonucleotides are complementary to nucleobases 20964-21018 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 391, 468, 1112-1116, and 1723-1741 are complementary to nucleobases 20964-21018 of SEQ ID NO: 2.

In certain embodiments, modified oligonucleotides complementary to nucleobases 20964-21018 of SEQ ID NO: 2 achieve at least 42% reduction of SNCA RNA in vitro in the standard cell assay.

7. Nucleobases 22454-22477 of SEQ ID NO: 2

In certain embodiments, nucleobases 22454-22477 of SEQ ID NO: 2 comprise a hotspot region. In certain embodiments, modified oligonucleotides are complementary to nucleobases 22454-22477 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 88, 1123-1126, and 1778-1782 are complementary to nucleobases 22454-22477 of SEQ ID NO: 2.

In certain embodiments, modified oligonucleotides complementary to nucleobases 22454-22477 of SEQ ID NO: 2 achieve at least 50% reduction of SNCA RNA in vitro in the standard cell assay.

8. Nucleobases 72294-72321 of SEQ ID NO: 2

In certain embodiments, nucleobases 72294-72321 of SEQ ID NO: 2 comprise a hotspot region. In certain embodiments, modified oligonucleotides are complementary to nucleobases 72294-72321 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 1323 and 2345-2353 are complementary to nucleobases 72294-72321 of SEQ ID NO: 2.

In certain embodiments, modified oligonucleotides complementary to nucleobases 72294-72321 of SEQ ID NO: 2 achieve at least 58% reduction of SNCA RNA in vitro in the standard cell assay.

9. Nucleobases 20549-20581 of SEQ ID NO: 2

In certain embodiments, nucleobases 20549-20581 of SEQ ID NO: 2 comprise a hotspot region. In certain embodiments, modified oligonucleotides are complementary to nucleobases 20549-20581 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 314 and 1107-1110 are complementary to nucleobases 20549-20581 of SEQ ID NO: 2.

In certain embodiments, modified oligonucleotides complementary to nucleobases 20549-20581 of SEQ ID NO: 2 achieve at least 58% reduction of SNCA RNA in vitro in the standard cell assay.

10. Nucleobases 27412-27432 of SEQ ID NO: 2

In certain embodiments, nucleobases 27412-27432 of SEQ ID NO: 2 comprise a hotspot region. In certain embodiments, modified oligonucleotides are complementary to nucleobases 27412-27432 of SEQ ID NO: 2. In certain embodiments, modified oligonucleotides are 17 or 20 nucleobases in length. In certain embodiments, modified oligonucleotides are gapmers. In certain embodiments, the gapmers are MOE gapmers or mixed cEt and MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 468, 1113-1114, and 1163 are complementary to nucleobases 27412-27432 of SEQ ID NO: 2.

In certain embodiments, modified oligonucleotides complementary to nucleobases 27412-27432 of SEQ ID NO: 2 achieve at least 62% reduction of SNCA RNA in vitro in the standard cell assay.

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "ATmCGAUCG," wherein mC indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (5), as a or such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of 5-8-4 MOE and cEt Gapmers with Mixed Internucleoside Linkages on Human SNCA In Vitro, Single Dose Modified oligonucleotides complementary to a human SNCA nucleic acid were designed and tested for their effect on SNCA mRNA in vitro. The modified oligonucleotides were tested in a series of experiments that had similar culture conditions.

Cultured SH-SY5Y cells at a density of 20,000 cells per well were transfected using electroporation with 7,000 nM concentration of modified oligonucleotide or no modified oligonucleotide for untreated controls. After approximately 24 hours, RNA was isolated from the cells and SNCA mRNA levels were measured by quantitative real-time PCR Human primer probe set RTS2621 (forward sequence ACGAACCTGAAGCCTAAGAAATATCT, designated herein as SEQ ID NO: 11; reverse sequence GAGCACTTGTACAGGATGGAACAT, designated herein as SEQ ID NO: 12; probe sequence TGCTCCCAAGTTTCTTGAGATCTGCTGACA, designated herein as SEQ ID: 13) was used to measure mRNA levels. SNCA mRNA levels were adjusted according to total RNA content, as measured by RIBOGREEN®. Results are presented in the tables below as percent reduction of the amount of SNCA mRNA, relative to untreated control cells (these conditions describe a "Standard Cell Assay"). The modified oligonucleotides marked with an asterisk (*) target the amplicon region of the primer probe set. Additional assays may be used to measure the potency and efficacy of oligonucleotides targeting the amplicon region. Compound No. 387978, previously disclosed in WO 2012/068405 was also tested and is a comparator oligonucleotide. Compound No. 387978 is a 5-10-5 MOE gapmer wherein each internucleoside linkage is a phosphorothioate internucleoside linkage and each cytosine residue is a 5-methyl cytosine.

The modified oligonucleotides in tables 1-7 are 5-8-4 mixed MOE and cEt gapmers. The gapmers are 17 nucleobases in length, wherein the central gap segment comprises eight 2'-deoxynucleosides and is flanked by a wing segment on the 5' end comprising five 2'-MOE nucleosides and a wing segment on the 3' end comprising two cEt nucleosides and two 2'-MOE nucleosides. The sugar motif for the gapmers is (from 5' to 3'): eeeeedddddddkkee; wherein 'd' represents a 2'-deoxyribose sugar; 'e' represents a 2'-MOE modified sugar; and represents a cEt modified sugar. All cytosine residues throughout each gapmer are 5-methyl cytosines. The internucleoside linkages are mixed phosphodiester and phosphorothioate linkages. The internucleoside linkage motif for the gapmers is (from 5' to 3'): sooossssssssssoss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the Tables below is complementary to human SNCA nucleic acid sequences SEQ ID NO: 1, SEQ ID NO: 2, SEQ ID NO: 3, SEQ ID NO: 4, SEQ ID NO: 5, or SEQ ID NO: 6, as indicated. 'N/A' indicates that the modified oligonucleotide is not complementary to that particular nucleic acid with 100% complementarity. A value of 0% reduction indicates that the compound had no effect or increased mRNA concentrations in the cell. As shown below, modified oligonucleotides complementary to human SNCA reduced the amount of human SNCA mRNA.

TABLE 1

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 64 | 21 |
| 709518 | 9 | 25 | 3191 | 3207 | TAGTCCTCCTCCTTCTC | 34 | 30 |
| 709524 | 102 | 118 | 3284 | 3300 | TGCAGCCCGCACGCACC | 33 | 31 |
| 709530 | 232 | 248 | N/A | N/A | TTACACCACACTGTCGT | 43 | 32 |
| 709536 | 240 | 256 | 4691 | 4707 | GAATTCCTTTACACCAC | 81 | 33 |
| 709542 | 256 | 272 | 4707 | 4723 | TACATCCATGGCTAATG | 53 | 34 |
| 709548 | 278 | 294 | 4729 | 4745 | CCTTTGAAAGTCCTTTC | 62 | 35 |
| 709554 | 288 | 304 | 4739 | 4755 | CCCTCCTTGGCCTTTGA | 54 | 36 |
| 709560 | 372 | 388 | N/A | N/A | GAGCCTACATAGAGAAC | 61 | 37 |
| 709566 | 385 | 401 | 12198 | 12214 | CTCCTTGGTTTTGGAGC | 22 | 38 |
| 709572 | 405 | 421 | 12218 | 12234 | GCCACACCATGCACCAC | 79 | 39 |
| 709578 | 440 | 456 | 18007 | 18023 | TTGTCACTTGCTCTTTG | 65 | 40 |
| 709584 | 450 | 466 | 18017 | 18033 | CCTCCAACATTTGTCAC | 23 | 41 |
| 709590 | 470 | 486 | 18037 | 18053 | TCACACCCGTCACCACT | 58 | 42 |
| 709596 | 512 | 528 | 18079 | 18095 | CAATGCTCCCTGCTCCC | 61 | 43 |
| 709602 | 584 | 600 | 111119 | 111135 | GAATTCCTTCCTGTGGG | 0 | 44 |
| 709608 | 650 | 666 | N/A | N/A | CTTGATACCCTTCCTCA | 0 | 45 |
| 709614* | 729 | 745 | 113797 | 113813 | CTTGTACAGGATGGAAC | 1 | 46 |
| 709620 | 789 | 805 | 113857 | 113873 | TTCGAGATACACTGTAA | 34 | 47 |
| 709626 | 798 | 814 | 113866 | 113882 | ATGGAAGACTTCGAGAT | 0 | 48 |
| 709632 | 866 | 882 | 113934 | 113950 | TCACTTCAGTGAAAGGG | 67 | 49 |
| 709638 | 892 | 908 | 113960 | 113976 | CACACAAAGACCCTGCT | 0 | 50 |
| 709644 | 906 | 922 | 113974 | 113990 | CACAAAATCCACAGCAC | 0 | 51 |
| 709650 | 934 | 950 | 114002 | 114018 | AATTTGTTTTAACATCG | 0 | 52 |
| 709656 | 956 | 972 | 114024 | 114040 | TGGTAGTCACTTAGGTG | 30 | 53 |
| 709662 | 1034 | 1050 | 114102 | 114118 | TCTTATAATATATGATA | 0 | 54 |
| 709668 | 1133 | 1149 | 114201 | 114217 | CATAGTTTCATGCTCAC | 66 | 55 |
| 709674 | 1213 | 1229 | 114281 | 114297 | TTCTCACCATTTATATA | 9 | 56 |
| 709680 | 1277 | 1293 | 114345 | 114361 | TATTATTAAAGTGAGAT | 13 | 57 |
| 709686 | 1327 | 1343 | 114395 | 114411 | TTTGTCCTTTGTGTCAG | 22 | 58 |
| 709692 | 1410 | 1426 | 114478 | 114494 | TCCGAGTGTAGGGTTAA | 12 | 59 |
| 709698 | 1476 | 1492 | 114544 | 114560 | AATCACAGCCACTTAAG | 11 | 60 |
| 709704 | 1590 | 1606 | 114658 | 114674 | ACATCAAACAACAGTTC | 0 | 61 |
| 709710 | 1716 | 1732 | 114784 | 114800 | AGGTACAGCATTCACAC | 14 | 62 |
| 709716 | 1744 | 1760 | 114812 | 114828 | CATGGTCGAATATTATT | 25 | 63 |
| 709722 | 1816 | 1832 | 114884 | 114900 | AAGGAGGGTGTAGTCAA | 40 | 64 |
| 709728 | 1882 | 1898 | 114950 | 114966 | AAGTTAACCACATTCTC | 5 | 65 |

TABLE 1-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709734 | 2013 | 2029 | 115081 | 115097 | GGTAGTTCCAACGATGT | 29 | 66 |
| 709740 | 2079 | 2095 | 115147 | 115163 | CAACATTTAAAGGAGGC | 35 | 67 |
| 709746 | 2165 | 2181 | 115233 | 115249 | TTTTCAGCACCCATGGG | 2 | 68 |
| 709752 | 2261 | 2277 | 115329 | 115345 | GTGACTTTTAGAAATGA | 43 | 69 |
| 709758 | 2327 | 2343 | 115395 | 115411 | CTCATGAATACATATAA | 11 | 70 |
| 709764 | 2400 | 2416 | 115468 | 115484 | TTCTATGGTAACCATCC | 37 | 71 |
| 709770 | 2469 | 2485 | 115537 | 115553 | TAGTGTAAGATGACACA | 11 | 72 |
| 709776 | 2540 | 2556 | 115608 | 115624 | ACTGTTCAATAACAAAT | 33 | 73 |
| 709782 | 2648 | 2664 | 115716 | 115732 | TCCTCTATTTCTTAATT | 1 | 74 |
| 709788 | 2714 | 2730 | 115782 | 115798 | TAAATTCATGGTCACAA | 68 | 75 |
| 709794 | 2783 | 2799 | 115851 | 115867 | AAAATTACCGTCAGATA | 36 | 76 |
| 709800 | 2867 | 2883 | 115935 | 115951 | AGGCTTATATGACTTAA | 12 | 77 |
| 709806 | 2933 | 2949 | 116001 | 116017 | GATTGATCCTCAGGCCA | 41 | 78 |
| 709812 | 2999 | 3015 | 116067 | 116083 | ACCGTGGAGTCATATGA | 0 | 79 |
| 709818 | 3065 | 3081 | 116133 | 116149 | ACACATTAGATTGTTCT | 16 | 80 |
| 709824 | 3131 | 3147 | 116199 | 116215 | GAAACATGTTTGCATCT | 47 | 81 |
| 709836 | N/A | N/A | 3445 | 3461 | GGCGACGCGAGGCTGGG | 22 | 82 |
| 709842 | N/A | N/A | 3553 | 3569 | ACAATTCCCAAATAATA | 6 | 83 |
| 709854 | N/A | N/A | 2097 | 2113 | GACAGCTGTTCCTGGAT | 32 | 84 |
| 709860 | N/A | N/A | 3957 | 3973 | ACCAAGAGAGCGGGCAG | 30 | 85 |
| 709866 | N/A | N/A | 8613 | 8629 | AAAGAATGCCACTAGGC | 23 | 86 |
| 709872 | N/A | N/A | 17660 | 17676 | TACAGGTGCAGTTATAT | 20 | 87 |
| 709878 | N/A | N/A | 22457 | 22473 | GCCTGTGACCTGTGCTT | 81 | 88 |
| 709884 | N/A | N/A | 27802 | 27818 | GACATCTCTAACATAAA | 56 | 89 |
| 709890 | N/A | N/A | 41133 | 41149 | AACAGATTCCAGCAGAG | 74 | 90 |
| 709896 | N/A | N/A | 48867 | 48883 | GATGGATATTGACTCCT | 53 | 91 |
| 709902 | N/A | N/A | 54583 | 54599 | TATATGCATTTTTCAGG | 48 | 92 |
| 709908 | N/A | N/A | 57557 | 57573 | AGACACTCTTACTTGAG | 0 | 93 |
| 709914 | N/A | N/A | 71391 | 71407 | TGAAGGACAACTGTGTA | 26 | 94 |
| 709922 | N/A | N/A | 75588 | 75604 | GACATCTGAAGTGTTCA | 59 | 95 |
| 709928 | N/A | N/A | 78911 | 78927 | ATAACCACCACTGAATT | 12 | 96 |
| 709934 | N/A | N/A | 80751 | 80767 | CCATGCTACATTGCTCA | 18 | 97 |
| 709940 | N/A | N/A | 83531 | 83547 | GAAAGAACAATGTCATC | 75 | 98 |
| 709946 | N/A | N/A | 89651 | 89667 | ACAAACCCAAAGAGATT | 51 | 99 |
|  | N/A | N/A | 88646 | 88662 |  |  |  |
| 709952 | N/A | N/A | 89681 | 89697 | GTCCCCAATCCCCACCC | 11 | 100 |
|  | N/A | N/A | 88676 | 88692 |  |  |  |

TABLE 1-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709958 | N/A | N/A | 89722 | 89738 | TCCTATAGAGATGAAGT | 40 | 101 |
|  | N/A | N/A | 88717 | 88733 |  |  |  |
| 709964 | N/A | N/A | 89731 | 89747 | TATCCACTCTCCTATAG | 0 | 102 |
|  | N/A | N/A | 88726 | 88742 |  |  |  |
| 709970 | N/A | N/A | 89191 | 89207 | TCCTTGAAAACTTCCAT | 48 | 103 |
| 709976 | N/A | N/A | 93421 | 93437 | GAGGTCAAATTTTCCAG | 30 | 104 |
| 709982 | N/A | N/A | 105440 | 105456 | GAGTGACAGTGGTGGGC | 28 | 105 |

TABLE 2

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 60 | 21 |
| 709519 | 22 | 38 | 3204 | 3220 | GTCCTCCTCCTCCTAGT | 32 | 106 |
| 709525 | 168 | 184 | 3350 | 3366 | GGCTTGAAGGCAAGGCG | 46 | 107 |
| 709531 | 233 | 249 | N/A | N/A | TTTACACCACACTGTCG | 33 | 108 |
| 709537 | 242 | 258 | 4693 | 4709 | ATGAATTCCTTTACACC | 46 | 109 |
| 709543 | 257 | 273 | 4708 | 4724 | ATACATCCATGGCTAAT | 62 | 110 |
| 709549 | 280 | 296 | 4731 | 4747 | GGCCTTTGAAAGTCCTT | 72 | 111 |
| 709555 | 301 | 317 | 4752 | 4768 | AGCAGCCACAACTCCCT | 75 | 112 |
| 709561 | 377 | 393 | N/A | N/A | TTTTGGAGCCTACATAG | 28 | 113 |
| 709567 | 387 | 403 | 12200 | 12216 | CCCTCCTTGGTTTTGGA | 46 | 114 |
| 709573 | 406 | 422 | 12219 | 12235 | TGCCACACCATGCACCA | 66 | 115 |
| 709579 | 442 | 458 | 18009 | 18025 | ATTTGTCACTTGCTCTT | 69 | 116 |
| 709585 | 453 | 469 | 18020 | 18036 | GCTCCTCCAACATTTGT | 57 | 117 |
| 709591 | 471 | 487 | 18038 | 18054 | GTCACACCCGTCACCAC | 71 | 118 |
| 709597 | 523 | 539 | 18090 | 18106 | AGTGGCTGCTGCAATGC | 68 | 119 |
| 709603 | 595 | 611 | 111130 | 111146 | CATATCTTCCAGAATTC | 9 | 120 |
| 709609* | 671 | 687 | 113739 | 113755 | CTTAGGCTTCAGGTTCG | 92 | 121 |
| 709615* | 740 | 756 | 113808 | 113824 | GGAACTGAGCACTTGTA | 67 | 122 |
| 709621 | 790 | 806 | 113858 | 113874 | CTTCGAGATACACTGTA | 31 | 123 |
| 709627 | 800 | 816 | 113868 | 113884 | TGATGGAAGACTTCGAG | 12 | 124 |
| 709633 | 877 | 893 | 113945 | 113961 | CTACCATGTATTCACTT | 53 | 125 |
| 709639 | 893 | 909 | 113961 | 113977 | GCACACAAAGACCCTGC | 33 | 126 |
| 709645 | 908 | 924 | 113976 | 113992 | GCCACAAAATCCACAGC | 56 | 127 |
| 709651 | 944 | 960 | 114012 | 114028 | AGGTGTTTTAATTTGT | 63 | 128 |

TABLE 2-continued

Percent reduction of human SNCA mRNA with 5-8-4 MOE
and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709657 | 967 | 983 | 114035 | 114051 | TTAGAAATAAGTGGTAG | 28 | 129 |
| 709663 | 1045 | 1061 | 114113 | 114129 | ACACCTAAAAATCTTAT | 26 | 130 |
| 709669 | 1144 | 1160 | 114212 | 114228 | ATTTATAGGTGCATAGT | 24 | 131 |
| 709675 | 1217 | 1233 | 114285 | 114301 | TTAATTCTCACCATTTA | 1 | 132 |
| 709681 | 1279 | 1295 | 114347 | 114363 | TTTATTATTAAAGTGAG | 4 | 133 |
| 709687 | 1347 | 1363 | 114415 | 114431 | GCTATTAATAACTTTAT | 6 | 134 |
| 709693 | 1421 | 1437 | 114489 | 114505 | CTTCAGGGAATTCCGAG | 35 | 135 |
| 709699 | 1487 | 1503 | 114555 | 114571 | TTTCAATAATTAATCAC | 16 | 136 |
| 709705 | 1628 | 1644 | 114696 | 114712 | GGCTCAATTAAAAATGT | 0 | 137 |
| 709711 | 1727 | 1743 | 114795 | 114811 | TATTGTCAGAAAGGTAC | 28 | 138 |
| 709717 | 1749 | 1765 | 114817 | 114833 | TTATTCATGGTCGAATA | 0 | 139 |
| 709723 | 1827 | 1843 | 114895 | 114911 | TATGGCTCTCTAAGGAG | 17 | 140 |
| 709729 | 1893 | 1909 | 114961 | 114977 | TGAGTTAAACAAAGTTA | 6 | 141 |
| 709735 | 2024 | 2040 | 115092 | 115108 | AAGGTGACTCTGGTAGT | 35 | 142 |
| 709741 | 2090 | 2106 | 115158 | 115174 | CATATATTTGGCAACAT | 27 | 143 |
| 709747 | 2177 | 2193 | 115245 | 115261 | CCATCAAGTTTATTTTC | 30 | 144 |
| 709753 | 2272 | 2288 | 115340 | 115356 | ACTTTCTACTAGTGACT | 16 | 145 |
| 709759 | 2338 | 2354 | 115406 | 115422 | ATATCACATTACTCATG | 22 | 146 |
| 709765 | 2414 | 2430 | 115482 | 115498 | GTAAAAAGGAAGTTTC | 11 | 147 |
| 709771 | 2480 | 2496 | 115548 | 115564 | CCATTTCTCTCTAGTGT | 16 | 148 |
| 709777 | 2551 | 2567 | 115619 | 115635 | TCCTGAAATATACTGTT | 5 | 149 |
| 709783 | 2659 | 2675 | 115727 | 115743 | GTCTAGTTCTGTCCTCT | 34 | 150 |
| 709789 | 2726 | 2742 | 115794 | 115810 | CACATAAATCCTTAAAT | 7 | 151 |
| 709795 | 2794 | 2810 | 115862 | 115878 | TTCACTGCTCAAAAATT | 8 | 152 |
| 709801 | 2878 | 2894 | 115946 | 115962 | GCTTCCTGAAAAGGCTT | 40 | 153 |
| 709807 | 2944 | 2960 | 116012 | 116028 | ACCTAGGACTGGATTGA | 1 | 154 |
| 709813 | 3010 | 3026 | 116078 | 116094 | TGGTAAAGCCGACCGTG | 29 | 155 |
| 709819 | 3076 | 3092 | 116144 | 116160 | AATACCAAACCACACAT | 4 | 156 |
| 709825 | 3145 | 3161 | 116213 | 116229 | GCCAGAAAGATGAGGAA | 13 | 157 |
| 709837 | N/A | N/A | 3456 | 3472 | CGCTGTGAGCCGGCGAC | 0 | 158 |
| 709843 | N/A | N/A | 3586 | 3602 | CCGCCTCTCTCTTTTTT | 26 | 159 |
| 709855 | N/A | N/A | 2112 | 2128 | CTTTCAGAGCTGGAAGA | 3 | 160 |
| 709861 | N/A | N/A | 4256 | 4272 | CAGAACTAACTGCTCAC | 28 | 161 |
| 709867 | N/A | N/A | 10668 | 10684 | AACATCACATGGGCTCA | 9 | 162 |
| 709873 | N/A | N/A | 18297 | 18313 | TCTGGGTTAATGCCTGA | 62 | 163 |
| 709879 | N/A | N/A | 23286 | 23302 | ATTGTTCTCAGAGACCA | 72 | 164 |

TABLE 2-continued

Percent reduction of human SNCA mRNA with 5-8-4 MOE
and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709885 | N/A | N/A | 31744 | 31760 | ACAGTAAAGATTTGCAT | 29 | 165 |
| 709891 | N/A | N/A | 42838 | 42854 | TGATGCCTCTACCTCCA | 70 | 166 |
| 709897 | N/A | N/A | 49481 | 49497 | TTGAAATTTTCCAGCTA | 69 | 167 |
|  | N/A | N/A | 80992 | 81008 |  |  |  |
| 709903 | N/A | N/A | 55047 | 55063 | TATACCTAATATGTTTG | 15 | 168 |
| 709909 | N/A | N/A | 58992 | 59008 | ATTTCATTAATCTGTGA | 63 | 169 |
| 709915 | N/A | N/A | 73191 | 73207 | CAGACTTTCTGTGTGGT | 77 | 170 |
| 709923 | N/A | N/A | 76780 | 76796 | AATTTGGAAGCTAATGT | 24 | 171 |
| 709929 | N/A | N/A | 79117 | 79133 | AGTTCCCATGAGACCAG | 56 | 172 |
| 709935 | N/A | N/A | 81199 | 81215 | TGGCTTGGAGCAAAAGG | 42 | 173 |
| 709941 | N/A | N/A | 85498 | 85514 | TTATGCAGTGGAACTAA | 20 | 174 |
| 709947 | N/A | N/A | 88649 | 88665 | CATACAAACCCAAAGAG | 0 | 175 |
|  | N/A | N/A | 89654 | 89670 |  |  |  |
| 709953 | N/A | N/A | 88708 | 88724 | GATGAAGTTAACTCCCT | 62 | 176 |
|  | N/A | N/A | 89713 | 89729 |  |  |  |
| 709959 | N/A | N/A | 88719 | 88735 | TCTCCTATAGAGATGAA | 0 | 177 |
|  | N/A | N/A | 89724 | 89740 |  |  |  |
| 709965 | N/A | N/A | 88728 | 88744 | TCTATCCACTCTCCTAT | 35 | 178 |
|  | N/A | N/A | 89733 | 89749 |  |  |  |
| 709971 | N/A | N/A | 89219 | 89235 | TCTGTTAACTGAGGTAG | 55 | 179 |
| 709977 | N/A | N/A | 93953 | 93969 | GGCTTCTGGCTGACTGA | 71 | 180 |
| 709983 | N/A | N/A | 106925 | 106941 | GAACATTAAAATTTGCA | 25 | 181 |

TABLE 3

Percent reduction of human SNCA mRNA with 5-8-4 MOE and cEt gapmers
with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 72 | 21 |
| 709520 | 44 | 60 | 3226 | 3242 | TGGGCCCCTTCTGGTCG | 14 | 182 |
| 709526 | 179 | 195 | 3361 | 3377 | GAAAGGCAGAAGGCTTG | 27 | 183 |
| 709532 | 234 | 250 | N/A | N/A | CTTTACACCACACTGTC | 45 | 184 |
| 709538 | 244 | 260 | 4695 | 4711 | TAATGAATTCCTTTACA | 35 | 185 |
| 709544 | 258 | 274 | 4709 | 4725 | AATACATCCATGGCTAA | 75 | 186 |
| 709550 | 282 | 298 | 4733 | 4749 | TTGGCCTTTGAAAGTCC | 77 | 187 |
| 709556 | 312 | 328 | 4763 | 4779 | GTTTTCTCAGCAGCAGC | 72 | 188 |
| 709562 | 379 | 395 | N/A | N/A | GGTTTTGGAGCCTACAT | 63 | 189 |
| 709568 | 395 | 411 | 12208 | 12224 | GCACCACTCCCTCCTTG | 55 | 190 |
| 709574 | 408 | 424 | 12221 | 12237 | GTTGCCACACCATGCAC | 49 | 191 |

TABLE 3-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709580 | 444 | 460 | 18011 | 18027 | ACATTTGTCACTTGCTC | 77 | 192 |
| 709586 | 464 | 480 | 18031 | 18047 | CCGTCACCACTGCTCCT | 83 | 193 |
| 709592 | 473 | 489 | 18040 | 18056 | CTGTCACACCCGTCACC | 78 | 194 |
| 709598 | 534 | 550 | 18101 | 18117 | TTGACAAAGCCAGTGGC | 31 | 195 |
| 709604 | 606 | 622 | 111141 | 111157 | GGATCCACAGGCATATC | 29 | 196 |
| 709610* | 682 | 698 | 113750 | 113766 | CAAAGATATTTCTTAGG | 23 | 197 |
| 709616* | 751 | 767 | 113819 | 113835 | CTGGGCACATTGGAACT | 4 | 198 |
| 709622 | 792 | 808 | 113860 | 113876 | GACTTCGAGATACACTG | 57 | 199 |
| 709628 | 811 | 827 | 113879 | 113895 | TCAATCACTGCTGATGG | 45 | 200 |
| 709634 | 887 | 903 | 113955 | 113971 | AAAGACCCTGCTACCAT | 52 | 201 |
| 709640 | 895 | 911 | 113963 | 113979 | CAGCACACAAAGACCCT | 65 | 202 |
| 709646 | 909 | 925 | 113977 | 113993 | AGCCACAAAATCCACAG | 56 | 203 |
| 709652 | 945 | 961 | 114013 | 114029 | TAGGTGTTTTAATTTG | 52 | 204 |
| 709658 | 978 | 994 | 114046 | 114062 | ATAGTGAGGATTTAGAA | 19 | 205 |
| 709664 | 1056 | 1072 | 114124 | 114140 | ATCATTAAAAGACACCT | 37 | 206 |
| 709670 | 1172 | 1188 | 114240 | 114256 | CGCAAAATGGTAAAATT | 25 | 207 |
| 709676 | 1226 | 1242 | 114294 | 114310 | CGTTTTATTTTAATTCT | 27 | 208 |
| 709682 | 1294 | 1310 | 114362 | 114378 | CTTATAAGCATGATTTT | 10 | 209 |
| 709688 | 1359 | 1375 | 114427 | 114443 | CTTCTTCAAATGGCTAT | 37 | 210 |
| 709694 | 1432 | 1448 | 114500 | 114516 | TGGCAGTGTTGCTTCAG | 63 | 211 |
| 709700 | 1520 | 1536 | 114588 | 114604 | CTACAATAGTAGTTGGG | 24 | 212 |
| 709706 | 1639 | 1655 | 114707 | 114723 | TGTTAATAAAAGGCTCA | 46 | 213 |
| 709712 | 1730 | 1746 | 114798 | 114814 | ATTTATTGTCAGAAAGG | 62 | 214 |
| 709718 | 1772 | 1788 | 114840 | 114856 | GGGAACCCACTTTTTTT | 17 | 215 |
| 709724 | 1838 | 1854 | 114906 | 114922 | CTAATGTGTCTTATGGC | 39 | 216 |
| 709730 | 1904 | 1920 | 114972 | 114988 | GTGAGGAATGCTGAGTT | 25 | 217 |
| 709736 | 2035 | 2051 | 115103 | 115119 | TGATCTCCTTTAAGGTG | 10 | 218 |
| 709742 | 2107 | 2123 | 115175 | 115191 | GGAAAAATCCTAGAATT | 6 | 219 |
| 709748 | 2188 | 2204 | 115256 | 115272 | AGAGTTTTTCACCATCA | 37 | 220 |
| 709754 | 2283 | 2299 | 115351 | 115367 | CTTGAAATTATACTTTC | 37 | 221 |
| 709760 | 2349 | 2365 | 115417 | 115433 | GCGCCCAATATATATCA | 30 | 222 |
| 709766 | 2425 | 2441 | 115493 | 115509 | TCTTCAATTAGGTAAAA | 17 | 223 |
| 709772 | 2491 | 2507 | 115559 | 115575 | CAAGAAACTTACCATTT | 11 | 224 |
| 709778 | 2562 | 2578 | 115630 | 115646 | CTTTCTAACCTTCCTGA | 21 | 225 |
| 709784 | 2670 | 2686 | 115738 | 115754 | CACTGCTATCAGTCTAG | 39 | 226 |
| 709790 | 2737 | 2753 | 115805 | 115821 | GAATTTGTATCCACATA | 53 | 227 |

TABLE 3-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709796 | 2806 | 2822 | 115874 | 115890 | TATATAAAGTAATTCAC | 12 | 228 |
| 709802 | 2889 | 2905 | 115957 | 115973 | ATATGAGACAAGCTTCC | 18 | 229 |
| 709808 | 2955 | 2971 | 116023 | 116039 | CTGCAAAATAAACCTAG | 41 | 230 |
| 709814 | 3021 | 3037 | 116089 | 116105 | CTGAACTGTTTTGGTAA | 30 | 231 |
| 709820 | 3087 | 3103 | 116155 | 116171 | ACCCCACTTGGAATACC | 37 | 232 |
| 709826 | 3156 | 3172 | 116224 | 116240 | ATACTGGATAAGCCAGA | 22 | 233 |
| 709832 | N/A | N/A | 18121 | 18137 | CCTTGCCCAACTGGTCC | 42 | 234 |
| 709838 | N/A | N/A | 3467 | 3483 | CCAGAGGAGGCCGCTGT | 15 | 235 |
| 709844 | N/A | N/A | 3597 | 3613 | CCGACTCCTCCCCGCCT | 24 | 236 |
| 709862 | N/A | N/A | 7047 | 7063 | TCTTTCCACTCTATCAG | 19 | 237 |
| 709868 | N/A | N/A | 10846 | 10862 | ACTGCATATTTAGAGTC | 13 | 238 |
| 709874 | N/A | N/A | 18424 | 18440 | ACATGAAAGCCCTCATT | 37 | 239 |
| 709880 | N/A | N/A | 25537 | 25553 | ATGAATTGCCACTATAA | 56 | 240 |
| 709886 | N/A | N/A | 32984 | 33000 | TGGATAAAAGAAGTTAC | 61 | 241 |
| 709892 | N/A | N/A | 43821 | 43837 | TACTTCTCTGGACCTCT | 74 | 242 |
| 709898 | N/A | N/A | 50921 | 50937 | TTTCATCAATATCTGCA | 90 | 243 |
| 709904 | N/A | N/A | 55614 | 55630 | AATTTAACCTTAAAGTA | 20 | 244 |
| 709910 | N/A | N/A | 59199 | 59215 | GTAGAGGCCCAATAAGT | 37 | 245 |
| 709916 | N/A | N/A | 74075 | 74091 | AGTTATTGCTATCAAGA | 57 | 246 |
| 709924 | N/A | N/A | 77666 | 77682 | GACTCTAGAAAAGCTCT | 70 | 247 |
| 709930 | N/A | N/A | 79403 | 79419 | CTTTTTCACTTGTCTCA | 48 | 248 |
| 709936 | N/A | N/A | 81475 | 81491 | AGAGCTGTTTGAAGTGA | 71 | 249 |
| 709942 | N/A | N/A | 85512 | 85528 | ACCTATGTTGAAACTTA | 48 | 250 |
| 709948 | N/A N/A | N/A N/A | 88651 89656 | 88667 89672 | GACATACAAACCCAAAG | 46 | 251 |
| 709954 | N/A N/A | N/A N/A | 88711 89716 | 88727 89732 | AGAGATGAAGTTAACTC | 61 | 252 |
| 709960 | N/A N/A | N/A N/A | 88720 89725 | 88736 89741 | CTCTCCTATAGAGATGA | 44 | 253 |
| 709966 | N/A N/A | N/A N/A | 88757 89762 | 88773 89778 | CCCTTTTCAAGAGCTTT | 82 | 254 |
| 709972 | N/A | N/A | 89254 | 89270 | TAAGCTCATATTTATAG | 23 | 255 |
| 709978 | N/A | N/A | 94005 | 94021 | TAAAAGATCATGAGGGC | 47 | 256 |
| 709984 | N/A | N/A | 107602 | 107618 | GAAACATGAGTTTAATA | 9 | 257 |

TABLE 4

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 71 | 21 |
| 709521 | 55 | 71 | 3237 | 3253 | GCCCCCTCTCTTGGGCC | 8 | 258 |
| 709527 | 190 | 206 | 3372 | 3388 | TCACGAGGGTGGAAAGG | 0 | 259 |
| 709533 | 236 | 252 | 4687 | 4703 | TCCTTTACACCACACTG | 63 | 260 |
| 709539 | 252 | 268 | 4703 | 4719 | TCCATGGCTAATGAATT | 24 | 261 |
| 709545 | 260 | 276 | 4711 | 4727 | TGAATACATCCATGGCT | 46 | 262 |
| 709551 | 283 | 299 | 4734 | 4750 | CTTGGCCTTTGAAAGTC | 72 | 263 |
| 709557 | 325 | 341 | 4776 | 4792 | CACACCCTGTTTGGTTT | 45 | 264 |
| 709563 | 381 | 397 | 12194 | 12210 | TTGGTTTTGGAGCCTAC | 69 | 265 |
| 709569 | 400 | 416 | 12213 | 12229 | ACCATGCACCACTCCCT | 41 | 266 |
| 709575 | 410 | 426 | 12223 | 12239 | CTGTTGCCACACCATGC | 45 | 267 |
| 709581 | 445 | 461 | 18012 | 18028 | AACATTTGTCACTTGCT | 65 | 268 |
| 709587 | 465 | 481 | 18032 | 18048 | CCCGTCACCACTGCTCC | 24 | 269 |
| 709593 | 475 | 491 | 18042 | 18058 | TGCTGTCACACCCGTCA | 55 | 270 |
| 709599 | 545 | 561 | 18112 | 18128 | ACTGGTCCTTTTTGACA | 15 | 271 |
| 709605 | 617 | 633 | 111152 | 111168 | CCTCATTGTCAGGATCC | 42 | 272 |
| 709611 | 693 | 709 | 113761 | 113777 | GAAACTGGGAGCAAAGA | 23 | 273 |
| 709617 | 762 | 778 | 113830 | 113846 | AAATGTCATGACTGGGC | 37 | 274 |
| 709623 | 793 | 809 | 113861 | 113877 | AGACTTCGAGATACACT | 36 | 275 |
| 709629 | 822 | 838 | 113890 | 113906 | GTACAGATACTTCAATC | 34 | 276 |
| 709635 | 888 | 904 | 113956 | 113972 | CAAAGACCCTGCTACCA | 8 | 277 |
| 709641 | 897 | 913 | 113965 | 113981 | CACAGCACACAAAGACC | 22 | 278 |
| 709647 | 910 | 926 | 113978 | 113994 | AAGCCACAAAATCCACA | 41 | 279 |
| 709653 | 947 | 963 | 114015 | 114031 | CTTAGGTGTTTTTAATT | 19 | 280 |
| 709659 | 1001 | 1017 | 114069 | 114085 | TTCTGAACAACAGCAAC | 41 | 281 |
| 709665 | 1067 | 1083 | 114135 | 114151 | TCTTAGACAGTATCATT | 38 | 282 |
| 709671 | 1183 | 1199 | 114251 | 114267 | ATAAAACACATCGCAAA | 13 | 283 |
| 709677 | 1241 | 1257 | 114309 | 114325 | TTTGCAATGAGATAACG | 8 | 284 |
| 709683 | 1295 | 1311 | 114363 | 114379 | GCTTATAAGCATGATTT | 22 | 285 |
| 709689 | 1370 | 1386 | 114438 | 114454 | TAAAATTCCTCCTTCTT | 4 | 286 |
| 709695 | 1443 | 1459 | 114511 | 114527 | AAACACACTTCTGGCAG | 19 | 287 |
| 709701 | 1531 | 1547 | 114599 | 114615 | AATAGACCACTCTACAA | 16 | 288 |
| 709707 | 1660 | 1676 | 114728 | 114744 | CGAGACAAAAATAACAA | 0 | 289 |
| 709713 | 1735 | 1751 | 114803 | 114819 | ATATTATTTATTGTCAG | 0 | 290 |
| 709719 | 1783 | 1799 | 114851 | 114867 | GCTTAGTTCCCGGGAAC | 5 | 291 |
| 709725 | 1849 | 1865 | 114917 | 114933 | GCTAATATGTGCTAATG | 29 | 292 |
| 709731 | 1930 | 1946 | 114998 | 115014 | GAATTTCTGATGATTAA | 9 | 293 |

TABLE 4-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709737 | 2046 | 2062 | 115114 | 115130 | GTCTAGAGAATTGATCT | 23 | 294 |
| 709743 | 2118 | 2134 | 115186 | 115202 | ACCTTTCCTAAGGAAAA | 0 | 295 |
| 709749 | 2200 | 2216 | 115268 | 115284 | ATTAATTTATACAGAGT | 5 | 296 |
| 709755 | 2294 | 2310 | 115362 | 115378 | GAATATTCTGTCTTGAA | 30 | 297 |
| 709761 | 2362 | 2378 | 115430 | 115446 | TCCTTCCTCACCAGCGC | 31 | 298 |
| 709767 | 2436 | 2452 | 115504 | 115520 | GTAGTAGTCTCTCTTCA | 26 | 299 |
| 709773 | 2507 | 2523 | 115575 | 115591 | CATAACTTAAATAAAAC | 0 | 300 |
| 709779 | 2573 | 2589 | 115641 | 115657 | CCTAACCGCCACTTTCT | 19 | 301 |
| 709785 | 2681 | 2697 | 115749 | 115765 | TTGTTCTAGGTCACTGC | 27 | 302 |
| 709791 | 2749 | 2765 | 115817 | 115833 | CACTTTAAAGGAGAATT | 0 | 303 |
| 709797 | 2827 | 2843 | 115895 | 115911 | GTCCCAAATAAACTATT | 0 | 304 |
| 709803 | 2900 | 2916 | 115968 | 115984 | CTCGGGAGTGAATATGA | 12 | 305 |
| 709809 | 2966 | 2982 | 116034 | 116050 | AGAATGTAAGTCTGCAA | 24 | 306 |
| 709815 | 3032 | 3048 | 116100 | 116116 | CAAAGTGCACTCTGAAC | 23 | 307 |
| 709821 | 3098 | 3114 | 116166 | 116182 | TTCTGAAAAAGACCCCA | 0 | 308 |
| 709827 | 3167 | 3183 | 116235 | 116251 | CAAATAGCTACATACTG | 2 | 309 |
| 709839 | N/A | N/A | 3495 | 3511 | CGGAGGCGGCACCCGGG | 8 | 310 |
| 709845 | N/A | N/A | 3608 | 3624 | TCTCCACAACTCCGACT | 18 | 311 |
| 709863 | N/A | N/A | 7156 | 7172 | TAATCAGGGAAGTGATG | 0 | 312 |
| 709869 | N/A | N/A | 14963 | 14979 | CTTCAGAAAATCTCCAG | 33 | 313 |
| 709875 | N/A | N/A | 20562 | 20578 | CACAACTATGCTGCAAT | 58 | 314 |
| 709881 | N/A | N/A | 25804 | 25820 | ATCATCCAGTAGAGTGA | 66 | 315 |
| 709887 | N/A | N/A | 33591 | 33607 | GAGAACACTTAAGTGAA | 44 | 316 |
| 709893 | N/A<br>N/A | N/A<br>N/A | 46160<br>53645 | 46176<br>53661 | ATTTCCATGAAGCCAAG | 88 | 317 |
| 709899 | N/A | N/A | 51477 | 51493 | CTAGAGACCACCTGAGA | 27 | 318 |
| 709905 | N/A | N/A | 56363 | 56379 | CTAATGAACAGAGAAAG | 2 | 319 |
| 709911 | N/A | N/A | 68799 | 68815 | CCAAAGTAAGAGGAGAT | 37 | 320 |
| 709917 | N/A | N/A | 74219 | 74235 | TGTTGCTAAGCACAAAC | 44 | 321 |
| 709925 | N/A | N/A | 78068 | 78084 | TCAAGGTGCCATATCTG | 51 | 322 |
| 709931 | N/A | N/A | 80286 | 80302 | AAAGAAAGGCAGTGTTG | 1 | 323 |
| 709937 | N/A | N/A | 82460 | 82476 | CCAATATGGATTCAGCA | 46 | 324 |
| 709943 | N/A | N/A | 86783 | 86799 | CAATTATTAGCAGTTAC | 55 | 325 |
| 709949 | N/A<br>N/A | N/A<br>N/A | 88653<br>89658 | 88669<br>89674 | TTGACATACAAACCCAA | 60 | 326 |
| 709955 | N/A<br>N/A | N/A<br>N/A | 88713<br>89718 | 88729<br>89734 | ATAGAGATGAAGTTAAC | 49 | 327 |

TABLE 4-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709961 | N/A | N/A | 88722 | 88738 | CACTCTCCTATAGAGAT | 0 | 328 |
|  | N/A | N/A | 89727 | 89743 |  |  |  |
| 709967 | N/A | N/A | 88759 | 88775 | TTCCCTTTTCAAGAGCT | 77 | 329 |
|  | N/A | N/A | 89764 | 89780 |  |  |  |
| 709973 | N/A | N/A | 91417 | 91433 | AGAAGGAATGCACAATA | 37 | 330 |
| 709979 | N/A | N/A | 94055 | 94071 | GCCATAATTCAAGTCAG | 63 | 331 |
| 709985 | N/A | N/A | 108049 | 108065 | ACTGACAACTTACAGCA | 30 | 332 |

TABLE 5

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 58 | 21 |
| 709522 | 66 | 82 | 3248 | 3264 | CTCGGTCGCTCGCCCCC | 36 | 333 |
| 709528 | 201 | 217 | 3383 | 3399 | CAGTTCTCCGCTCACGA | 26 | 334 |
| 709534 | 237 | 253 | 4688 | 4704 | TTCCTTTACACCACACT | 60 | 335 |
| 709540 | 254 | 270 | 4705 | 4721 | CATCCATGGCTAATGAA | 47 | 336 |
| 709546 | 262 | 278 | 4713 | 4729 | CATGAATACATCCATGG | 31 | 337 |
| 709552 | 284 | 300 | 4735 | 4751 | CCTTGGCCTTTGAAAGT | 41 | 338 |
| 709558 | 336 | 352 | 4787 | 4803 | GCTGCTTCTGCCACACC | 61 | 339 |
| 709564 | 382 | 398 | 12195 | 12211 | CTTGGTTTTGGAGCCTA | 63 | 340 |
| 709570 | 402 | 418 | 12215 | 12231 | ACACCATGCACCACTCC | 56 | 341 |
| 709576 | 418 | 434 | N/A | N/A | CTCAGCCACTGTTGCCA | 57 | 342 |
| 709582 | 446 | 462 | 18013 | 18029 | CAACATTTGTCACTTGC | 72 | 343 |
| 709588 | 467 | 483 | 18034 | 18050 | CACCCGTCACCACTGCT | 56 | 344 |
| 709594 | 486 | 502 | 18053 | 18069 | TTCTGGGCTACTGCTGT | 11 | 345 |
| 709600 | 556 | 572 | N/A | N/A | ATTCTTGCCCAACTGGT | 7 | 346 |
| 709606 | 628 | 644 | 111163 | 111179 | CATTTCATAAGCCTCAT | 12 | 347 |
| 709612* | 704 | 720 | 113772 | 113788 | GCAGATCTCAAGAAACT | 45 | 348 |
| 709618 | 778 | 794 | 113846 | 113862 | CTGTAAAAACTTTGAGA | 27 | 349 |
| 709624 | 794 | 810 | 113862 | 113878 | AAGACTTCGAGATACAC | 43 | 350 |
| 709630 | 844 | 860 | 113912 | 113928 | CCGAAATGCTGAGTGGG | 29 | 351 |
| 709636 | 889 | 905 | 113957 | 113973 | ACAAAGACCCTGCTACC | 14 | 352 |
| 709642 | 899 | 915 | 113967 | 113983 | TCCACAGCACACAAAGA | 30 | 353 |
| 709648 | 912 | 928 | 113980 | 113996 | TGAAGCCACAAAATCCA | 28 | 354 |
| 709654 | 949 | 965 | 114017 | 114033 | CACTTAGGTGTTTTTAA | 26 | 355 |
| 709660 | 1012 | 1028 | 114080 | 114096 | TCACTAACAACTTCTGA | 34 | 356 |

TABLE 5-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709666 | 1091 | 1107 | 114159 | 114175 | ACAAATTTCACAATACG | 32 | 357 |
| 709672 | 1198 | 1214 | 114266 | 114282 | TACAAACACAAGTGAAT | 14 | 358 |
| 709678 | 1266 | 1282 | 114334 | 114350 | TGAGATGGGATAAAAAT | 9 | 359 |
| 709684 | 1305 | 1321 | 114373 | 114389 | AATTCATGTTGCTTATA | 0 | 360 |
| 709690 | 1383 | 1399 | 114451 | 114467 | TCTCTACCTCTTCTAAA | 0 | 361 |
| 709696 | 1454 | 1470 | 114522 | 114538 | AGTGCATACCAAAACAC | 9 | 362 |
| 709702 | 1549 | 1565 | 114617 | 114633 | GACAGGATTGAAGGGAG | 26 | 363 |
| 709708 | 1671 | 1687 | 114739 | 114755 | AAAAATTATTTCGAGAC | 0 | 364 |
| 709714 | 1738 | 1754 | 114806 | 114822 | CGAATATTATTTATTGT | 0 | 365 |
| 709720 | 1794 | 1810 | 114862 | 114878 | TCTTCTACACTGCTTAG | 14 | 366 |
| 709726 | 1860 | 1876 | 114928 | 114944 | GCCTTGAATGTGCTAAT | 38 | 367 |
| 709732 | 1991 | 2007 | 115059 | 115075 | GGCATTTCCTGTAAAAA | 21 | 368 |
| 709738 | 2057 | 2073 | 115125 | 115141 | AATTTTTATCAGTCTAG | 45 | 369 |
| 709744 | 2137 | 2153 | 115205 | 115221 | TCTTCCCTGAAAGAGAA | 6 | 370 |
| 709750 | 2239 | 2255 | 115307 | 115323 | CCCCAGAATAATTAAAA | 1 | 371 |
| 709756 | 2305 | 2321 | 115373 | 115389 | TAGCATGTCTAGAATAT | 23 | 372 |
| 709762 | 2378 | 2394 | 115446 | 115462 | GTCACTCATTCCTCCTT | 24 | 373 |
| 709768 | 2447 | 2463 | 115515 | 115531 | CTTAGCACTCTGTAGTA | 9 | 374 |
| 709774 | 2518 | 2534 | 115586 | 115602 | CCTTGCTTAAACATAAC | 16 | 375 |
| 709780 | 2596 | 2612 | 115664 | 115680 | CTTTAGGTAGATTTAAA | 0 | 376 |
| 709786 | 2692 | 2708 | 115760 | 115776 | CTAATCTCAAATTGTTC | 12 | 377 |
| 709792 | 2761 | 2777 | 115829 | 115845 | TAAGGGAAGAAACACTT | 11 | 378 |
| 709798 | 2838 | 2854 | 115906 | 115922 | TTAAGTGTTTGGTCCCA | 53 | 379 |
| 709804 | 2911 | 2927 | 115979 | 115995 | CAGGTGAATGTCTCGGG | 29 | 380 |
| 709810 | 2977 | 2993 | 116045 | 116061 | AATAACTTGGGAGAATG | 6 | 381 |
| 709816 | 3043 | 3059 | 116111 | 116127 | CAATTGTGTGCCAAAGT | 15 | 382 |
| 709822 | 3109 | 3125 | 116177 | 116193 | TAGTGCAGAGATTCTGA | 38 | 383 |
| 709828 | 3174 | 3190 | 116242 | 116258 | TATGTCACAAATAGCTA | 3 | 384 |
| 709834 | N/A | N/A | 3415 | 3431 | AACCCGCTAACCTGTCG | 16 | 385 |
| 709840 | N/A | N/A | 3506 | 3522 | CACAGGAAGGGCGGAGG | 10 | 386 |
| 709846 | N/A | N/A | 3619 | 3635 | GTCCCTCTGCTTCTCCA | 4 | 387 |
| 709858 | N/A | N/A | 2166 | 2182 | CATACACACGCGAACTT | 4 | 388 |
| 709864 | N/A | N/A | 7240 | 7256 | TCAATTATTCATATGTC | 18 | 389 |
| 709870 | N/A | N/A | 15701 | 15717 | CTGCACAGTAAAATGTA | 8 | 390 |
| 709876 | N/A | N/A | 20986 | 21002 | AGTGTGAGCAAACATTC | 50 | 391 |
| 709876 | N/A | N/A | 27411 | 27427 | AGTGTGAGCAAACATTC | 50 | 391 |

TABLE 5-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709882 | N/A | N/A | 25926 | 25942 | AATTGAATACATTGTCT | 63 | 392 |
| 709888 | N/A | N/A | 39106 | 39122 | TCCTAAAGTATTGCACT | 31 | 393 |
| 709894 | N/A | N/A | 48228 | 48244 | CCTGGTCATGACTCTGA | 62 | 394 |
| 709900 | N/A | N/A | 52420 | 52436 | GATCAAATGTATAGAGA | 62 | 395 |
| 709906 | N/A | N/A | 56773 | 56789 | AGAGGCAGGGCTAGACA | 13 | 396 |
| 709912 | N/A | N/A | 68801 | 68817 | TGCCAAAGTAAGAGGAG | 56 | 397 |
| 709919 | N/A | N/A | 74295 | 74311 | ATAGAACTCTGTAGTCA | 72 | 398 |
| 709926 | N/A | N/A | 78080 | 78096 | CAAATGAACTTCTCAAG | 7 | 399 |
| 709932 | N/A | N/A | 80397 | 80413 | AAATTACACTGTTGAAT | 32 | 400 |
| 709938 | N/A | N/A | 82770 | 82786 | GGCAAAGGGCTCTGGTG | 34 | 401 |
| 709944 | N/A | N/A | 87946 | 87962 | GTAAGTTGTGACCATGC | 76 | 402 |
| 709950 | N/A | N/A | 88655 | 88671 | ACTTGACATACAAACCC | 45 | 403 |
| 709950 | N/A | N/A | 89660 | 89676 | ACTTGACATACAAACCC | 45 | 403 |
| 709956 | N/A | N/A | 88714 | 88730 | TATAGAGATGAAGTTAA | 26 | 404 |
|  | N/A | N/A | 89719 | 89735 |  |  |  |
| 709962 | N/A | N/A | 88723 | 88739 | CCACTCTCCTATAGAGA | 18 | 405 |
|  | N/A | N/A | 89728 | 89744 |  |  |  |
| 709968 | N/A | N/A | 88761 | 88777 | ATTTCCCTTTTCAAGAG | 19 | 406 |
|  | N/A | N/A | 89766 | 89782 |  | 19 | 406 |
| 709974 | N/A | N/A | 92159 | 92175 | TAACTCCATTTAATTGT | 17 | 407 |
| 709980 | N/A | N/A | 99285 | 99301 | ACAGTACACTATTTGTT | 25 | 408 |
| 709986 | N/A | N/A | 109588 | 109604 | ACCACCCCAAACTACCT | 0 | 409 |

TABLE 6

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 64 | 21 |
| 709523 | 91 | 107 | 3273 | 3289 | CGCACCTCACTTCCGCG | 20 | 410 |
| 709529 | 212 | 228 | 3394 | 3410 | ATGGCCACTCCCAGTTC | 21 | 411 |
| 709535 | 238 | 254 | 4689 | 4705 | ATTCCTTTACACCACAC | 84 | 412 |
| 709541 | 255 | 271 | 4706 | 4722 | ACATCCATGGCTAATGA | 43 | 413 |
| 709547 | 266 | 282 | 4717 | 4733 | CTTTCATGAATACATCC | 81 | 414 |
| 709553 | 286 | 302 | 4737 | 4753 | CTCCTTGGCCTTTGAAA | 31 | 415 |
| 709559 | 361 | 377 | 4812 | 4828 | GAGAACACCCTCTTTTG | 15 | 416 |
| 709565 | 383 | 399 | 12196 | 12212 | CCTGGTTTTGGAGCCT | 63 | 417 |
| 709571 | 404 | 420 | 12217 | 12233 | CCACACCATGCACCACT | 63 | 418 |

TABLE 6-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709577 | 431 | 447 | 17998 | 18014 | GCTCTTTGGTCTTCTCA | 45 | 419 |
| 709583 | 448 | 464 | 18015 | 18031 | TCCAACATTTGTCACTT | 22 | 420 |
| 709589 | 469 | 485 | 18036 | 18052 | CACACCCGTCACCACTG | 48 | 421 |
| 709595 | 501 | 517 | 18068 | 18084 | GCTCCCTCCACTGTCTT | 28 | 422 |
| 709601 | 567 | 583 | N/A | N/A | GCTCCTTCTTCATTCTT | 5 | 423 |
| 709607 | 639 | 655 | N/A | N/A | TCCTCAGAAGGCATTTC | 0 | 424 |
| 709613* | 715 | 731 | 113783 | 113799 | AACATCTGTCAGCAGAT | 56 | 425 |
| 709619 | 788 | 804 | 113856 | 113872 | TCGAGATACACTGTAAA | 18 | 426 |
| 709625 | 796 | 812 | 113864 | 113880 | GGAAGACTTCGAGATAC | 64 | 427 |
| 709631 | 855 | 871 | 113923 | 113939 | AAAGGGAAGCACCGAAA | 25 | 428 |
| 709637 | 891 | 907 | 113959 | 113975 | ACACAAAGACCCTGCTA | 12 | 429 |
| 709643 | 904 | 920 | 113972 | 113988 | CAAAATCCACAGCACAC | 50 | 430 |
| 709649 | 914 | 930 | 113982 | 113998 | ATTGAAGCCACAAAATC | 13 | 431 |
| 709655 | 952 | 968 | 114020 | 114036 | AGTCACTTAGGTGTTTT | 32 | 432 |
| 709661 | 1023 | 1039 | 114091 | 114107 | ATGATAGCAAATCACTA | 22 | 433 |
| 709667 | 1122 | 1138 | 114190 | 114206 | GCTCACATATTTTTAAG | 18 | 434 |
| 709673 | 1209 | 1225 | 114277 | 114293 | CACCATTTATATACAAA | 20 | 435 |
| 709679 | 1274 | 1290 | 114342 | 114358 | TATTAAAGTGAGATGGG | 28 | 436 |
| 709685 | 1316 | 1332 | 114384 | 114400 | TGTCAGTTCTTAATTCA | 17 | 437 |
| 709691 | 1399 | 1415 | 114467 | 114483 | GGTTAATGTTCCATTTT | 29 | 438 |
| 709697 | 1465 | 1481 | 114533 | 114549 | CTTAAGGAACCAGTGCA | 30 | 439 |
| 709703 | 1579 | 1595 | 114647 | 114663 | CAGTTCCCCAAAATACG | 0 | 440 |
| 709709 | 1705 | 1721 | 114773 | 114789 | TCACACCAATATCAGAC | 36 | 441 |
| 709715 | 1740 | 1756 | 114808 | 114824 | GTCGAATATTATTTATT | 11 | 442 |
| 709721 | 1805 | 1821 | 114873 | 114889 | AGTCAAATCATCTTCT | 17 | 443 |
| 709727 | 1871 | 1887 | 114939 | 114955 | ATTCTCTCAGAGCCTTG | 72 | 444 |
| 709733 | 2002 | 2018 | 115070 | 115086 | CGATGTTTAAAGGCATT | 0 | 445 |
| 709739 | 2068 | 2084 | 115136 | 115152 | GGAGGCCATGAAATTTT | 39 | 446 |
| 709745 | 2148 | 2164 | 115216 | 115232 | GAGTTAATAGATCTTCC | 36 | 447 |
| 709751 | 2250 | 2266 | 115318 | 115334 | AAATGACTATGCCCCAG | 44 | 448 |
| 709757 | 2316 | 2332 | 115384 | 115400 | ATATAAACTGCTAGCAT | 23 | 449 |
| 709763 | 2389 | 2405 | 115457 | 115473 | CCATCCTTATAGTCACT | 48 | 450 |
| 709769 | 2458 | 2474 | 115526 | 115542 | GACACATGCAGCTTAGC | 42 | 451 |
| 709775 | 2529 | 2545 | 115597 | 115613 | ACAAATCCTTTCCTTGC | 12 | 452 |
| 709781 | 2631 | 2647 | 115699 | 115715 | TAATACCAATACTTTTA | 21 | 453 |
| 709787 | 2703 | 2719 | 115771 | 115787 | TCAACTTTCCTAATC | 0 | 454 |
| 709793 | 2772 | 2788 | 115840 | 115856 | CAGATAAATATTAAGGG | 0 | 455 |

TABLE 6-continued

Percent reduction of human SNCA mRNA with 5-8-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 709799 | 2856 | 2872 | 115924 | 115940 | ACTTAAAGAACTTTTTG | 11 | 456 |
| 709805 | 2922 | 2938 | 115990 | 116006 | AGGCCACTTGGCAGGTG | 16 | 457 |
| 709811 | 2988 | 3004 | 116056 | 116072 | ATATGAGGCTGAATAAC | 16 | 458 |
| 709817 | 3054 | 3070 | 116122 | 116138 | TGTTCTGTTCCCAATTG | 48 | 459 |
| 709823 | 3120 | 3136 | 116188 | 116204 | GCATCTCACACTAGTGC | 30 | 460 |
| 709829 | 3180 | 3196 | 116248 | 116264 | ATTTATTATGTCACAAA | 0 | 461 |
| 709835 | N/A | N/A | 3426 | 3442 | AGTGGGAGGCAAACCCG | 8 | 462 |
| 709841 | N/A | N/A | 3517 | 3533 | GAAAGGAGCGCACAGG | 32 | 463 |
| 709853 | N/A | N/A | 2086 | 2102 | CTGGATCACACCAGAAT | 16 | 464 |
| 709859 | N/A<br>N/A | N/A<br>N/A | 2500<br>112970 | 2516<br>112986 | CTATCACCATTTTCCTT | 13 | 465 |
| 709865 | N/A | N/A | 7406 | 7422 | AGCCATAAGTGAAATTA | 48 | 466 |
| 709871 | N/A | N/A | 15993 | 16009 | AGTTCGATTTAAATGCC | 27 | 467 |
| 709877 | N/A<br>N/A | N/A<br>N/A | 20988<br>27413 | 21004<br>27429 | ACAGTGTGAGCAAACAT | 62 | 468 |
| 709883 | N/A | N/A | 26205 | 26221 | CCCTCTTTGTGTTATAC | 74 | 469 |
| 709889 | N/A | N/A | 40203 | 40219 | GAAAGTTTTTATGGAGA | 22 | 470 |
| 709895 | N/A | N/A | 48716 | 48732 | TGTATTTTGGATGCTTC | 85 | 471 |
| 709901 | N/A | N/A | 52979 | 52995 | GAAGTGACTATGTCTTC | 46 | 472 |
| 709907 | N/A | N/A | 57491 | 57507 | GCCAAATGAATGGGCCA | 59 | 473 |
| 709913 | N/A | N/A | 68942 | 68958 | ATCAAAAGGAACATCAA | 35 | 474 |
| 709921 | N/A | N/A | 75328 | 75344 | TATTCTTCTCCTCCATG | 34 | 475 |
| 709927 | N/A | N/A | 78404 | 78420 | AATGTTGGCAAGCTTGA | 48 | 476 |
| 709933 | N/A | N/A | 80489 | 80505 | ACTCACACTGCCTAGCT | 36 | 477 |
| 709939 | N/A | N/A | 83333 | 83349 | CCTATATATTCAAGATG | 22 | 478 |
| 709945 | N/A | N/A | 88047 | 88063 | AGAAGCTATCAAGACAT | 60 | 479 |
| 709951 | N/A<br>N/A | N/A<br>N/A | 88657<br>89662 | 88673<br>89678 | CCACTTGACATACAAAC | 24 | 480 |
| 709957<br>709957 | N/A<br>N/A | N/A<br>N/A | 88715<br>89720 | 88731<br>89736 | CTATAGAGATGAAGTTA | 39 | 481 |
| 709963<br>709963 | N/A<br>N/A | N/A<br>N/A | 88725<br>89730 | 88741<br>89746 | ATCCACTCTCCTATAGA | 6 | 482 |
| 709969 | N/A | N/A | 89098 | 89114 | AATAGGAGTTCAATGAA | 33 | 483 |
| 709975 | N/A | N/A | 93354 | 93370 | GTTAGATAATTATTGAG | 20 | 484 |
| 709981 | N/A | N/A | 100015 | 100031 | CTTCAAACCTTTTGACC | 15 | 485 |
| 709987 | N/A | N/A | 110359 | 110375 | CCTATTTATGGTATAAT | 0 | 486 |

TABLE 7

Percent reduction of human SNCA mRNA with 5-8-4 MOE and cEt gapmers with mixed internucleoside linkages

| Compound No | SEQ ID NO: 3 start | SEQ ID NO: 3 stop | SEQ ID NO: 4 start | SEQ ID NO: 4 stop | SEQ ID NO: 5 start | SEQ ID NO: 5 stop | SEQ ID NO: 6 start | SEQ ID NO: 6 stop | Sequence (5' to 3') | % Reduction | SEQ ID NO |
|---|---|---|---|---|---|---|---|---|---|---|---|
| 709830 | 369 | 385 | N/A | N/A | N/A | N/A | N/A | N/A | ACTACATAGAGAACACC | 60 | 487 |
| 709831 | 380 | 396 | N/A | N/A | N/A | N/A | N/A | N/A | TCTTCTCAGCCACTACA | 23 | 488 |
| 709833 | 523 | 539 | N/A | N/A | N/A | N/A | N/A | N/A | TTGATACCCTTCCTTGC | 0 | 489 |
| 709847 | N/A | N/A | 388 | 404 | N/A | N/A | N/A | N/A | ACCACACTGAGTCCCTC | 0 | 490 |
| 709848 | N/A | N/A | 389 | 405 | N/A | N/A | N/A | N/A | CACCACACTGAGTCCCT | 22 | 491 |
| 709849 | N/A | N/A | 390 | 406 | N/A | N/A | N/A | N/A | ACACCACACTGAGTCCC | 11 | 492 |
| 709850 | N/A | N/A | 392 | 408 | N/A | N/A | N/A | N/A | TTACACCACACTGAGTC | 26 | 493 |
| 709851 | N/A | N/A | 393 | 409 | N/A | N/A | N/A | N/A | TTTACACCACACTGAGT | 23 | 494 |
| 709852 | N/A | N/A | 394 | 410 | N/A | N/A | N/A | N/A | CTTTACACCACACTGAG | 24 | 495 |
| 709856 | N/A | N/A | N/A | N/A | 38 | 54 | N/A | N/A | TACACCACACTCTTTCA | 22 | 496 |
| 709857 | N/A | N/A | N/A | N/A | N/A | N/A | 89 | 105 | CCACACTCACTTCCGCG | 15 | 497 |

Example 2: Effect of 4-9-4 MOE and cEt Gapmers with Mixed Internucleoside Linkages on Human SNCA In Vitro, Single Dose Modified oligonucleotides complementary to a human SNCA nucleic acid were designed and tested as described in Example 1 for their effect on SNCA mRNA in vitro. The modified oligonucleotides were tested in a series of experiments that had similar culture conditions.

The modified oligonucleotides marked with an asterisk (*) target the amplicon region of the primer probe set. Additional assays may be used to measure the potency and efficacy of oligonucleotides targeting the amplicon region. Compound No. 387978, previously disclosed in WO 2012/068405 was also tested and is a comparator oligonucleotide. Compound No. 387978 is a 5-10-5 MOE gapmer wherein each internucleoside linkage is a phosphorothioate internucleoside linkage and each cytosine residue is a 5-methyl cytosine.

The modified oligonucleotides in tables 7-13 are 4-9-4 MOE and cEt gapmers. The gapmers are 17 nucleobases in length, wherein the central gap segment comprises nine 2'-deoxynucleosides and is flanked by wing segments on both the 5' end on the 3' end comprising two 2'-MOE nucleosides and two cEt nucleosides. The sugar motif for the gapmers is (from 5' to 3'): eekkddddddddkkee; wherein 'd' represents a 2'-deoxyribose sugar; 'e' represents a 2'-MOE modified sugar; and 'k' represents a cEt modified sugar. All cytosine residues throughout each gapmer are 5-methyl cytosines. The internucleoside linkages are mixed phosphodiester and phosphorothioate linkages. The internucleoside linkage motif for the gapmers is (from 5' to 3'): sooossssssssssoss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the Tables below is complementary to human SNCA nucleic acid sequences SEQ ID NO: 1 or SEQ ID NO: 2, as indicated. 'N/A' indicates that the modified oligonucleotide is not complementary to that particular nucleic acid with 100% complementarity. A value of 0% reduction indicates that the compound had no effect or increased mRNA concentrations in the cell. As shown below, modified oligonucleotides complementary to human SNCA reduced the amount of human SNCA mRNA.

TABLE 8

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 9 | 21 |
| 740410 | 240 | 256 | 4691 | 4707 | GAATTCCTTTACACCAC | 92 | 33 |
| 740316 | N/A | N/A | 3416 | 3432 | AAACCCGCTAACCTGTC | 16 | 498 |
| 740317 | N/A | N/A | 3419 | 3435 | GGCAAACCCGCTAACCT | 47 | 499 |

TABLE 8-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740318 | N/A | N/A | 3422 | 3438 | GGAGGCAAACCCGCTAA | 13 | 500 |
| 740319 | N/A | N/A | 3425 | 3441 | GTGGGAGGCAAACCCGC | 2 | 501 |
| 740320 | N/A | N/A | 3428 | 3444 | GGAGTGGGAGGCAAACC | 18 | 502 |
| 740321 | N/A | N/A | 3446 | 3462 | CGGCGACGCGAGGCTGG | 16 | 503 |
| 740322 | N/A | N/A | 3449 | 3465 | AGCCGGCGACGCGAGGC | 25 | 504 |
| 740323 | N/A | N/A | 3452 | 3468 | GTGAGCCGGCGACGCGA | 51 | 505 |
| 740324 | N/A | N/A | 3455 | 3471 | GCTGTGAGCCGGCGACG | 66 | 506 |
| 740325 | N/A | N/A | 3458 | 3474 | GCCGCTGTGAGCCGGCG | 5 | 507 |
| 740326 | N/A | N/A | 3463 | 3479 | AGGAGGCCGCTGTGAGC | 45 | 508 |
| 740327 | N/A | N/A | 3466 | 3482 | CAGAGGAGGCCGCTGTG | 21 | 509 |
| 740328 | N/A | N/A | 3469 | 3485 | CCCCAGAGGAGGCCGCT | 23 | 510 |
| 740329 | N/A | N/A | 3472 | 3488 | TGTCCCCAGAGGAGGCC | 0 | 511 |
| 740330 | N/A | N/A | 3475 | 3491 | GACTGTCCCCAGAGGAG | 24 | 512 |
| 740331 | N/A | N/A | 3496 | 3512 | GCGGAGGCGGCACCCGG | 13 | 513 |
| 740332 | N/A | N/A | 3499 | 3515 | AGGGCGGAGGCGGCACC | 25 | 514 |
| 740333 | N/A | N/A | 3502 | 3518 | GGAAGGGCGGAGGCGGC | 28 | 515 |
| 740334 | N/A | N/A | 3505 | 3521 | ACAGGAAGGGCGGAGGC | 1 | 516 |
| 740335 | N/A | N/A | 3508 | 3524 | CGCACAGGAAGGGCGGA | 19 | 517 |
| 740336 | N/A | N/A | 3511 | 3527 | GAGCGCACAGGAAGGGC | 33 | 518 |
| 740337 | N/A | N/A | 3514 | 3530 | AAGGAGCGCACAGGAAG | 64 | 519 |
| 740338 | N/A | N/A | 3518 | 3534 | GGAAAAGGAGCGCACAG | 40 | 520 |
| 740339 | N/A | N/A | 3521 | 3537 | GAAGGAAAAGGAGCGCA | 36 | 521 |
| 740340 | N/A | N/A | 3532 | 3548 | ATAGGAAAGAAGAAGGA | 42 | 522 |
| 740341 | N/A | N/A | 3536 | 3552 | TTTAATAGGAAAGAAGA | 3 | 523 |
| 740342 | N/A | N/A | 3540 | 3556 | AATATTTAATAGGAAAG | 0 | 524 |
| 740343 | N/A | N/A | 3548 | 3564 | TCCCAAATAATATTTAA | 42 | 525 |
| 740344 | N/A | N/A | 3551 | 3567 | AATTCCCAAATAATATT | 28 | 526 |
| 740345 | N/A | N/A | 3554 | 3570 | AACAATTCCCAAATAAT | 33 | 527 |
| 740346 | N/A | N/A | 3558 | 3574 | TTTAAACAATTCCCAAA | 15 | 528 |
| 740347 | N/A | N/A | 3561 | 3577 | AAATTTAAACAATTCCC | 48 | 529 |
| 740348 | N/A | N/A | 3587 | 3603 | CCCGCCTCTCTCTTTTT | 20 | 530 |
| 740349 | N/A | N/A | 3590 | 3606 | CTCCCCGCCTCTCTCTT | 0 | 531 |
| 740350 | N/A | N/A | 3594 | 3610 | ACTCCTCCCCGCCTCTC | 2 | 532 |
| 740351 | N/A | N/A | 3598 | 3614 | TCCGACTCCTCCCCGCC | 40 | 533 |
| 740352 | N/A | N/A | 3601 | 3617 | AACTCCGACTCCTCCCC | 55 | 534 |
| 740353 | N/A | N/A | 3604 | 3620 | CACAACTCCGACTCCTC | 56 | 535 |

TABLE 8-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740354 | N/A | N/A | 3607 | 3623 | CTCCACAACTCCGACTC | 31 | 536 |
| 740355 | N/A | N/A | 3610 | 3626 | CTTCTCCACAACTCCGA | 41 | 537 |
| 740356 | N/A | N/A | 3613 | 3629 | CTGCTTCTCCACAACTC | 27 | 538 |
| 740357 | N/A | N/A | 3616 | 3632 | CCTCTGCTTCTCCACAA | 30 | 539 |
| 740358 | N/A | N/A | 3620 | 3636 | AGTCCCTCTGCTTCTCC | 0 | 540 |
| 740359 | N/A | N/A | 3623 | 3639 | CTGAGTCCCTCTGCTTC | 26 | 541 |
| 740369 | 10 | 26 | 3192 | 3208 | CTAGTCCTCCTCCTTCT | 14 | 542 |
| 740370 | 23 | 39 | 3205 | 3221 | CGTCCTCCTCCTCCTAG | 27 | 543 |
| 740371 | 28 | 44 | 3210 | 3226 | GTCGCCGTCCTCCTCCT | 0 | 544 |
| 740372 | 45 | 61 | 3227 | 3243 | TTGGGCCCTTCTGGTC | 0 | 545 |
| 740373 | 48 | 64 | 3230 | 3246 | CTCTTGGGCCCCTTCTG | 42 | 546 |
| 740374 | 51 | 67 | 3233 | 3249 | CCTCTCTTGGGCCCCTT | 43 | 547 |
| 740375 | 54 | 70 | 3236 | 3252 | CCCCCTCTCTTGGGCCC | 31 | 548 |
| 740376 | 57 | 73 | 3239 | 3255 | TCGCCCCTCTCTTGGG | 0 | 549 |
| 740377 | 60 | 76 | 3242 | 3258 | CGCTCGCCCCTCTCTT | 23 | 550 |
| 740378 | 63 | 79 | 3245 | 3261 | GGTCGCTCGCCCCTCT | 35 | 551 |
| 740379 | 67 | 83 | 3249 | 3265 | GCTCGGTCGCTCGCCCC | 53 | 552 |
| 740380 | 92 | 108 | 3274 | 3290 | ACGCACCTCACTTCCGC | 58 | 553 |
| 740381 | 95 | 111 | 3277 | 3293 | CGCACGCACCTCACTTC | 43 | 554 |
| 740382 | 98 | 114 | 3280 | 3296 | GCCCGCACGCACCTCAC | 42 | 555 |
| 740383 | 101 | 117 | 3283 | 3299 | GCAGCCCGCACGCACCT | 44 | 556 |
| 740384 | 104 | 120 | 3286 | 3302 | GCTGCAGCCCGCACGCA | 19 | 557 |
| 740385 | 107 | 123 | 3289 | 3305 | TGCGCTGCAGCCCGCAC | 4 | 558 |
| 740386 | 110 | 126 | 3292 | 3308 | GTCTGCGCTGCAGCCCG | 59 | 559 |
| 740387 | 169 | 185 | 3351 | 3367 | AGGCTTGAAGGCAAGGC | 69 | 560 |
| 740388 | 172 | 188 | 3354 | 3370 | AGAAGGCTTGAAGGCAA | 66 | 561 |
| 740389 | 175 | 191 | 3357 | 3373 | GGCAGAAGGCTTGAAGG | 44 | 562 |
| 740390 | 178 | 194 | 3360 | 3376 | AAAGGCAGAAGGCTTGA | 44 | 563 |
| 740391 | 181 | 197 | 3363 | 3379 | TGGAAAGGCAGAAGGCT | 59 | 564 |
| 740392 | 184 | 200 | 3366 | 3382 | GGGTGGAAAGGCAGAAG | 32 | 565 |

TABLE 9

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 9 | 21 |
| 740410 | 240 | 256 | 4691 | 4707 | GAATTCCTTTACACCAC | 86 | 33 |
| 740393 | 187 | 203 | 3369 | 3385 | CGAGGGTGGAAAGGCAG | 56 | 566 |
| 740394 | 191 | 207 | 3373 | 3389 | CTCACGAGGGTGGAAAG | 30 | 567 |
| 740395 | 194 | 210 | 3376 | 3392 | CCGCTCACGAGGGTGGA | 57 | 568 |
| 740396 | 197 | 213 | 3379 | 3395 | TCTCCGCTCACGAGGGT | 40 | 569 |
| 740397 | 200 | 216 | 3382 | 3398 | AGTTCTCCGCTCACGAG | 52 | 570 |
| 740398 | 203 | 219 | 3385 | 3401 | CCCAGTTCTCCGCTCAC | 43 | 571 |
| 740399 | 206 | 222 | 3388 | 3404 | ACTCCCAGTTCTCCGCT | 33 | 572 |
| 740400 | 209 | 225 | 3391 | 3407 | GCCACTCCCAGTTCTCC | 44 | 573 |
| 740401 | 213 | 229 | 3395 | 3411 | AATGGCCACTCCCAGTT | 38 | 574 |
| 740402 | 216 | 232 | 3398 | 3414 | TCGAATGGCCACTCCCA | 45 | 575 |
| 740403 | 233 | 249 | N/A | N/A | TTTACACCACACTGTCG | 50 | 108 |
| 740404 | 234 | 250 | N/A | N/A | CTTTACACCACACTGTC | 62 | 577 |
| 740405 | 235 | 251 | N/A | N/A | CCTTTACACCACACTGT | 77 | 576 |
| 740406 | 236 | 252 | 4687 | 4703 | TCCTTTACACCACACTG | 85 | 260 |
| 740407 | 237 | 253 | 4688 | 4704 | TTCCTTTACACCACACT | 88 | 335 |
| 740408* | 238 | 254 | 4689 | 4705 | ATTCCTTTACACCACAC | 83 | 412 |
| 740409* | 239 | 255 | 4690 | 4706 | AATTCCTTTACACCACA | 89 | 577 |
| 740411 | 241 | 257 | 4692 | 4708 | TGAATTCCTTTACACCA | 83 | 578 |
| 740412 | 242 | 258 | 4693 | 4709 | ATGAATTCCTTTACACC | 87 | 584 |
| 740413 | 243 | 259 | 4694 | 4710 | AATGAATTCCTTTACAC | 78 | 579 |
| 740414 | 245 | 261 | 4696 | 4712 | CTAATGAATTCCTTTAC | 82 | 580 |
| 740415 | 246 | 262 | 4697 | 4713 | GCTAATGAATTCCTTTA | 80 | 581 |
| 740416 | 249 | 265 | 4700 | 4716 | ATGGCTAATGAATTCCT | 89 | 582 |
| 740417 | 253 | 269 | 4704 | 4720 | ATCCATGGCTAATGAAT | 64 | 583 |
| 740418 | 254 | 270 | 4705 | 4721 | CATCCATGGCTAATGAA | 69 | 336 |
| 740419 | 255 | 271 | 4706 | 4722 | ACATCCATGGCTAATGA | 76 | 413 |
| 740420 | 256 | 272 | 4707 | 4723 | TACATCCATGGCTAATG | 73 | 34 |
| 740421 | 257 | 273 | 4708 | 4724 | ATACATCCATGGCTAAT | 74 | 593 |
| 740422 | 258 | 274 | 4709 | 4725 | AATACATCCATGGCTAA | 85 | 186 |
| 740423 | 259 | 275 | 4710 | 4726 | GAATACATCCATGGCTA | 76 | 584 |
| 740424 | 260 | 276 | 4711 | 4727 | TGAATACATCCATGGCT | 77 | 262 |
| 740425 | 261 | 277 | 4712 | 4728 | ATGAATACATCCATGGC | 83 | 585 |
| 740426 | 263 | 279 | 4714 | 4730 | TCATGAATACATCCATG | 55 | 586 |
| 740427 | 265 | 281 | 4716 | 4732 | TTTCATGAATACATCCA | 88 | 587 |
| 740428 | 266 | 282 | 4717 | 4733 | CTTTCATGAATACATCC | 76 | 414 |

TABLE 9-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740429 | 267 | 283 | 4718 | 4734 | CCTTTCATGAATACATC | 86 | 588 |
| 740430 | 268 | 284 | 4719 | 4735 | TCCTTTCATGAATACAT | 91 | 589 |
| 740431 | 269 | 285 | 4720 | 4736 | GTCCTTTCATGAATACA | 82 | 590 |
| 740432 | 270 | 286 | 4721 | 4737 | AGTCCTTTCATGAATAC | 92 | 591 |
| 740433 | 271 | 287 | 4722 | 4738 | AAGTCCTTTCATGAATA | 68 | 592 |
| 740434 | 273 | 289 | 4724 | 4740 | GAAAGTCCTTTCATGAA | 67 | 593 |
| 740435 | 275 | 291 | 4726 | 4742 | TTGAAAGTCCTTTCATG | 25 | 594 |
| 740436 | 276 | 292 | 4727 | 4743 | TTTGAAAGTCCTTTCAT | 8 | 595 |
| 740437 | 277 | 293 | 4728 | 4744 | CTTTGAAAGTCCTTTCA | 66 | 596 |
| 740438 | 278 | 294 | 4729 | 4745 | CCTTTGAAAGTCCTTTC | 86 | 35 |
| 740439 | 279 | 295 | 4730 | 4746 | GCCTTTGAAAGTCCTTT | 88 | 597 |
| 740440 | 280 | 296 | 4731 | 4747 | GGCCTTTGAAAGTCCTT | 88 | 111 |
| 740441 | 281 | 297 | 4732 | 4748 | TGGCCTTTGAAAGTCCT | 58 | 598 |
| 740442 | 282 | 298 | 4733 | 4749 | TTGGCCTTTGAAAGTCC | 68 | 187 |
| 740443 | 283 | 299 | 4734 | 4750 | CTTGGCCTTTGAAAGTC | 75 | 263 |
| 740444 | 285 | 301 | 4736 | 4752 | TCCTTGGCCTTTGAAAG | 47 | 599 |
| 740445 | 286 | 302 | 4737 | 4753 | CTCCTTGGCCTTTGAAA | 57 | 415 |
| 740446 | 301 | 317 | 4752 | 4768 | AGCAGCCACAACTCCCT | 62 | 112 |
| 740447 | 302 | 318 | 4753 | 4769 | CAGCAGCCACAACTCCC | 65 | 600 |
| 740448 | 304 | 320 | 4755 | 4771 | AGCAGCAGCCACAACTC | 63 | 601 |
| 740449 | 305 | 321 | 4756 | 4772 | CAGCAGCAGCCACAACT | 52 | 602 |
| 740450 | 308 | 324 | 4759 | 4775 | TCTCAGCAGCAGCCACA | 63 | 603 |
| 740451 | 309 | 325 | 4760 | 4776 | TTCTCAGCAGCAGCCAC | 69 | 604 |
| 740452 | 311 | 327 | 4762 | 4778 | TTTTCTCAGCAGCAGCC | 75 | 605 |
| 740453 | 312 | 328 | 4763 | 4779 | GTTTTCTCAGCAGCAGC | 66 | 188 |
| 740454 | 313 | 329 | 4764 | 4780 | GGTTTTCTCAGCAGCAG | 79 | 606 |
| 740455 | 314 | 330 | 4765 | 4781 | TGGTTTTCTCAGCAGCA | 78 | 607 |
| 740456 | 317 | 333 | 4768 | 4784 | GTTTGGTTTTCTCAGCA | 82 | 608 |
| 740457 | 326 | 342 | 4777 | 4793 | CCACACCCTGTTTGGTT | 71 | 609 |
| 740458 | 329 | 345 | 4780 | 4796 | CTGCCACACCCTGTTTG | 54 | 610 |
| 740459 | 332 | 348 | 4783 | 4799 | CTTCTGCCACACCCTGT | 74 | 611 |
| 740460 | 333 | 349 | 4784 | 4800 | GCTTCTGCCACACCCTG | 73 | 612 |
| 740461 | 335 | 351 | 4786 | 4802 | CTGCTTCTGCCACACCC | 80 | 613 |
| 740462 | 336 | 352 | 4787 | 4803 | GCTGCTTCTGCCACACC | 77 | 339 |
| 740463 | 338 | 354 | 4789 | 4805 | CTGCTGCTTCTGCCACA | 64 | 614 |
| 740464 | 339 | 355 | 4790 | 4806 | CCTGCTGCTTCTGCCAC | 52 | 615 |

TABLE 9-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
| --- | --- | --- | --- | --- | --- | --- | --- |
| 740465 | 342 | 358 | 4793 | 4809 | TTTCCTGCTGCTTCTGC | 63 | 616 |
| 740466 | 345 | 361 | 4796 | 4812 | GTCTTTCCTGCTGCTTC | 69 | 617 |
| 740467 | 348 | 364 | 4799 | 4815 | TTTGTCTTTCCTGCTGC | 56 | 618 |
| 740468 | 362 | 378 | 4813 | 4829 | AGAGAACACCCTCTTTT | 47 | 619 |
| 740469 | 365 | 381 | 4816 | 4832 | CATAGAGAACACCCTCT | 71 | 620 |
| 740470 | 368 | 384 | 4819 | 4835 | CTACATAGAGAACACCC | 81 | 621 |

TABLE 10

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
| --- | --- | --- | --- | --- | --- | --- | --- |
| 387978 | 282 | 301 | 4733 | 4752 | TCCTTGGCCTTTGAAAGTCC | 32 | 21 |
| 740410 | 240 | 256 | 4691 | 4707 | GAATTCCTTTACACCAC | 90 | 33 |
| 740471 | 369 | 385 | 4820 | 4836 | CCTACATAGAGAACACC | 76 | 622 |
| 740472 | 371 | 387 | N/A | N/A | AGCCTACATAGAGAACA | 51 | 623 |
| 740473 | 372 | 388 | N/A | N/A | GAGCCTACATAGAGAAC | 74 | 37 |
| 740474 | 373 | 389 | N/A | N/A | GGAGCCTACATAGAGAA | 65 | 624 |
| 740475 | 374 | 390 | N/A | N/A | TGGAGCCTACATAGAGA | 46 | 625 |
| 740476 | 375 | 391 | N/A | N/A | TTGGAGCCTACATAGAG | 61 | 626 |
| 740477 | 378 | 394 | N/A | N/A | GTTTTGGAGCCTACATA | 56 | 627 |
| 740478 | 379 | 395 | N/A | N/A | GGTTTTGGAGCCTACAT | 72 | 189 |
| 740479 | 380 | 396 | 12193 | 12209 | TGGTTTTGGAGCCTACA | 78 | 628 |
| 740480 | 381 | 397 | 12194 | 12210 | TTGGTTTTGGAGCCTAC | 64 | 265 |
| 740481 | 382 | 398 | 12195 | 12211 | CTTGGTTTTGGAGCCTA | 43 | 340 |
| 740482 | 383 | 399 | 12196 | 12212 | CCTTGGTTTTGGAGCCT | 81 | 417 |
| 740483 | 384 | 400 | 12197 | 12213 | TCCTTGGTTTTGGAGCC | 79 | 629 |
| 740484 | 385 | 401 | 12198 | 12214 | CTCCTTGGTTTTGGAGC | 21 | 38 |
| 740485 | 386 | 402 | 12199 | 12215 | CCTCCTTGGTTTTGGAG | 19 | 630 |
| 740486 | 388 | 404 | 12201 | 12217 | TCCCTCCTTGGTTTTGG | 63 | 631 |
| 740487 | 391 | 407 | 12204 | 12220 | CACTCCCTCCTTGGTTT | 71 | 632 |
| 740488 | 396 | 412 | 12209 | 12225 | TGCACCACTCCCTCCTT | 62 | 633 |
| 740489 | 399 | 415 | 12212 | 12228 | CCATGCACCACTCCCTC | 51 | 634 |
| 740490 | 400 | 416 | 12213 | 12229 | ACCATGCACCACTCCCT | 61 | 266 |
| 740491 | 401 | 417 | 12214 | 12230 | CACCATGCACCACTCCC | 80 | 635 |
| 740492 | 402 | 418 | 12215 | 12231 | ACACCATGCACCACTCC | 69 | 341 |
| 740493 | 403 | 419 | 12216 | 12232 | CACACCATGCACCACTC | 69 | 636 |

TABLE 10-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740494 | 404 | 420 | 12217 | 12233 | CCACACCATGCACCACT | 78 | 418 |
| 740495 | 406 | 422 | 12219 | 12235 | TGCCACACCATGCACCA | 75 | 646 |
| 740496 | 407 | 423 | 12220 | 12236 | TTGCCACACCATGCACC | 68 | 637 |
| 740497 | 408 | 424 | 12221 | 12237 | GTTGCCACACCATGCAC | 50 | 191 |
| 740498 | 409 | 425 | 12222 | 12238 | TGTTGCCACACCATGCA | 81 | 638 |
| 740499 | 410 | 426 | 12223 | 12239 | CTGTTGCCACACCATGC | 79 | 267 |
| 740500 | 411 | 427 | N/A | N/A | ACTGTTGCCACACCATG | 88 | 639 |
| 740501 | 418 | 434 | N/A | N/A | CTCAGCCACTGTTGCCA | 68 | 342 |
| 740502 | 419 | 435 | N/A | N/A | TCTCAGCCACTGTTGCC | 66 | 640 |
| 740503 | 421 | 437 | N/A | N/A | CTTCTCAGCCACTGTTG | 57 | 641 |
| 740504 | 422 | 438 | N/A | N/A | TCTTCTCAGCCACTGTT | 59 | 642 |
| 740505 | 427 | 443 | 17994 | 18010 | TTTGGTCTTCTCAGCCA | 41 | 643 |
| 740506 | 432 | 448 | 17999 | 18015 | TGCTCTTTGGTCTTCTC | 27 | 644 |
| 740507 | 435 | 451 | 18002 | 18018 | ACTTGCTCTTTGGTCTT | 66 | 645 |
| 740508 | 437 | 453 | 18004 | 18020 | TCACTTGCTCTTTGGTC | 83 | 646 |
| 740509 | 438 | 454 | 18005 | 18021 | GTCACTTGCTCTTTGGT | 89 | 647 |
| 740510 | 439 | 455 | 18006 | 18022 | TGTCACTTGCTCTTTGG | 87 | 648 |
| 740511 | 440 | 456 | 18007 | 18023 | TTGTCACTTGCTCTTTG | 79 | 40 |
| 740512 | 441 | 457 | 18008 | 18024 | TTTGTCACTTGCTCTTT | 72 | 649 |
| 740513 | 442 | 458 | 18009 | 18025 | ATTTGTCACTTGCTCTT | 82 | 116 |
| 740514 | 443 | 459 | 18010 | 18026 | CATTTGTCACTTGCTCT | 76 | 650 |
| 740515 | 444 | 460 | 18011 | 18027 | ACATTTGTCACTTGCTC | 80 | 192 |
| 740516 | 445 | 461 | 18012 | 18028 | AACATTTGTCACTTGCT | 80 | 268 |
| 740517 | 446 | 462 | 18013 | 18029 | CAACATTTGTCACTTGC | 86 | 343 |
| 740518 | 447 | 463 | 18014 | 18030 | CCAACATTTGTCACTTG | 48 | 651 |
| 740519 | 448 | 464 | 18015 | 18031 | TCCAACATTTGTCACTT | 40 | 420 |
| 740520 | 449 | 465 | 18016 | 18032 | CTCCAACATTTGTCACT | 56 | 652 |
| 740521 | 451 | 467 | 18018 | 18034 | TCCTCCAACATTTGTCA | 17 | 653 |
| 740522 | 454 | 470 | 18021 | 18037 | TGCTCCTCCAACATTTG | 49 | 654 |
| 740523 | 457 | 473 | 18024 | 18040 | CACTGCTCCTCCAACAT | 60 | 655 |
| 740524 | 460 | 476 | 18027 | 18043 | CACCACTGCTCCTCCAA | 81 | 656 |
| 740525 | 463 | 479 | 18030 | 18046 | CGTCACCACTGCTCCTC | 55 | 657 |
| 740526 | 464 | 480 | 18031 | 18047 | CCGTCACCACTGCTCCT | 69 | 193 |
| 740527 | 466 | 482 | 18033 | 18049 | ACCCGTCACCACTGCTC | 87 | 658 |
| 740528 | 467 | 483 | 18034 | 18050 | CACCCGTCACCACTGCT | 82 | 344 |
| 740529 | 468 | 484 | 18035 | 18051 | ACACCCGTCACCACTGC | 76 | 659 |

TABLE 10-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740530 | 470 | 486 | 18037 | 18053 | TCACACCCGTCACCACT | 77 | 681 |
| 740531 | 471 | 487 | 18038 | 18054 | GTCACACCCGTCACCAC | 79 | 118 |
| 740532 | 472 | 488 | 18039 | 18055 | TGTCACACCCGTCACCA | 72 | 660 |
| 740533 | 473 | 489 | 18040 | 18056 | CTGTCACACCCGTCACC | 88 | 194 |
| 740534 | 474 | 490 | 18041 | 18057 | GCTGTCACACCCGTCAC | 84 | 661 |
| 740535 | 476 | 492 | 18043 | 18059 | CTGCTGTCACACCCGTC | 85 | 662 |
| 740536 | 479 | 495 | 18046 | 18062 | CTACTGCTGTCACACCC | 75 | 663 |
| 740537 | 482 | 498 | 18049 | 18065 | GGGCTACTGCTGTCACA | 59 | 664 |
| 740538 | 485 | 501 | 18052 | 18068 | TCTGGGCTACTGCTGTC | 54 | 665 |
| 740539 | 488 | 504 | 18055 | 18071 | TCTTCTGGGCTACTGCT | 48 | 666 |
| 740540 | 491 | 507 | 18058 | 18074 | CTGTCTTCTGGGCTACT | 61 | 667 |
| 740541 | 494 | 510 | 18061 | 18077 | CCACTGTCTTCTGGGCT | 61 | 668 |
| 740542 | 498 | 514 | 18065 | 18081 | CCCTCCACTGTCTTCTG | 26 | 669 |
| 740543 | 502 | 518 | 18069 | 18085 | TGCTCCCTCCACTGTCT | 62 | 670 |
| 740544 | 510 | 526 | 18077 | 18093 | ATGCTCCCTGCTCCCTC | 70 | 671 |
| 740545 | 513 | 529 | 18080 | 18096 | GCAATGCTCCCTGCTCC | 88 | 672 |
| 740546 | 523 | 539 | 18090 | 18106 | AGTGGCTGCTGCAATGC | 61 | 119 |
| 740547 | 526 | 542 | 18093 | 18109 | GCCAGTGGCTGCTGCAA | 58 | 673 |

TABLE 11

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 11 | 21 |
| 740410 | 240 | 256 | 4691 | 4707 | GAATTCCTTTACACCAC | 89 | 33 |
| 740548 | 529 | 545 | 18096 | 18112 | AAAGCCAGTGGCTGCTG | 76 | 674 |
| 740549 | 532 | 548 | 18099 | 18115 | GACAAAGCCAGTGGCTG | 72 | 675 |
| 740550 | 535 | 551 | 18102 | 18118 | TTTGACAAAGCCAGTGG | 63 | 676 |
| 740551 | 538 | 554 | 18105 | 18121 | CTTTTTGACAAAGCCAG | 71 | 677 |
| 740552 | 541 | 557 | 18108 | 18124 | GTCCTTTTGACAAAGC | 31 | 678 |
| 740553 | 544 | 560 | 18111 | 18127 | CTGGTCCTTTTTGACAA | 50 | 679 |
| 740554 | 547 | 563 | 18114 | 18130 | CAACTGGTCCTTTTTGA | 67 | 680 |
| 740555 | 550 | 566 | 18117 | 18133 | GCCCAACTGGTCCTTTT | 73 | 681 |
| 740556 | 553 | 569 | 18120 | 18136 | CTTGCCCAACTGGTCCT | 55 | 682 |
| 740557 | 557 | 573 | N/A | N/A | CATTCTTGCCCAACTGG | 15 | 683 |
| 740558 | 560 | 576 | N/A | N/A | CTTCATTCTTGCCCAAC | 60 | 684 |

TABLE 11-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740559 | 563 | 579 | N/A | N/A | CTTCTTCATTCTTGCCC | 72 | 685 |
| 740560 | 566 | 582 | N/A | N/A | CTCCTTCTTCATTCTTG | 48 | 686 |
| 740561 | 569 | 585 | 111104 | 111120 | GGGCTCCTTCTTCATTC | 60 | 687 |
| 740562 | 585 | 601 | 111120 | 111136 | AGAATTCCTTCCTGTGG | 38 | 688 |
| 740563 | 588 | 604 | 111123 | 111139 | TCCAGAATTCCTTCCTG | 63 | 689 |
| 740564 | 591 | 607 | 111126 | 111142 | TCTTCCAGAATTCCTTC | 45 | 690 |
| 740565 | 594 | 610 | 111129 | 111145 | ATATCTTCCAGAATTCC | 63 | 691 |
| 740566 | 597 | 613 | 111132 | 111148 | GGCATATCTTCCAGAAT | 73 | 692 |
| 740567 | 600 | 616 | 111135 | 111151 | ACAGGCATATCTTCCAG | 48 | 693 |
| 740568 | 603 | 619 | 111138 | 111154 | TCCACAGGCATATCTTC | 46 | 694 |
| 740569 | 607 | 623 | 111142 | 111158 | AGGATCCACAGGCATAT | 34 | 695 |
| 740570 | 610 | 626 | 111145 | 111161 | GTCAGGATCCACAGGCA | 72 | 696 |
| 740571 | 613 | 629 | 111148 | 111164 | ATTGTCAGGATCCACAG | 21 | 697 |
| 740572 | 616 | 632 | 111151 | 111167 | CTCATTGTCAGGATCCA | 75 | 698 |
| 740573 | 619 | 635 | 111154 | 111170 | AGCCTCATTGTCAGGAT | 79 | 699 |
| 740574 | 622 | 638 | 111157 | 111173 | ATAAGCCTCATTGTCAG | 31 | 700 |
| 740575 | 625 | 641 | 111160 | 111176 | TTCATAAGCCTCATTGT | 0 | 701 |
| 740576 | 627 | 643 | 111162 | 111178 | ATTTCATAAGCCTCATT | 35 | 702 |
| 740577 | 629 | 645 | 111164 | 111180 | GCATTTCATAAGCCTCA | 78 | 703 |
| 740578 | 632 | 648 | 111167 | 111183 | AAGGCATTTCATAAGCC | 67 | 704 |
| 740579 | 635 | 651 | 111170 | 111186 | CAGAAGGCATTTCATAA | 70 | 705 |
| 740580 | 638 | 654 | 111173 | 111189 | CCTCAGAAGGCATTTCA | 31 | 706 |
| 740581 | 641 | 657 | N/A | N/A | CTTCCTCAGAAGGCATT | 62 | 707 |
| 740582 | 644 | 660 | N/A | N/A | ACCCTTCCTCAGAAGGC | 60 | 708 |
| 740583 | 647 | 663 | N/A | N/A | GATACCCTTCCTCAGAA | 4 | 709 |
| 740584 | 651 | 667 | N/A | N/A | TCTTGATACCCTTCCTC | 29 | 710 |
| 740585 | 654 | 670 | 113722 | 113738 | TAGTCTTGATACCCTTC | 70 | 711 |
| 740586 | 672 | 688 | 113740 | 113756 | TCTTAGGCTTCAGGTTC | 66 | 712 |
| 740587 | 675 | 691 | 113743 | 113759 | ATTTCTTAGGCTTCAGG | 47 | 713 |
| 740588 | 678 | 694 | 113746 | 113762 | GATATTTCTTAGGCTTC | 61 | 714 |
| 740589 | 681 | 697 | 113749 | 113765 | AAAGATATTTCTTAGGC | 43 | 715 |
| 740590 | 684 | 700 | 113752 | 113768 | AGCAAAGATATTTCTTA | 49 | 716 |
| 740591 | 687 | 703 | 113755 | 113771 | GGGAGCAAAGATATTTC | 80 | 717 |
| 740592 | 690 | 706 | 113758 | 113774 | ACTGGGAGCAAAGATAT | 55 | 718 |
| 740593 | 694 | 710 | 113762 | 113778 | AGAAACTGGGAGCAAAG | 86 | 719 |
| 740594 | 697 | 713 | 113765 | 113781 | TCAAGAAACTGGGAGCA | 49 | 720 |

TABLE 11-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740595 | 700 | 716 | 113768 | 113784 | ATCTCAAGAAACTGGGA | 69 | 721 |
| 740596 | 703 | 719 | 113771 | 113787 | CAGATCTCAAGAAACTG | 72 | 722 |
| 740597 | 706 | 722 | 113774 | 113790 | CAGCAGATCTCAAGAAA | 72 | 723 |
| 740598 | 709 | 725 | 113777 | 113793 | TGTCAGCAGATCTCAAG | 47 | 724 |
| 740599 | 712 | 728 | 113780 | 113796 | ATCTGTCAGCAGATCTC | 32 | 725 |
| 740600 | 716 | 732 | 113784 | 113800 | GAACATCTGTCAGCAGA | 0 | 726 |
| 740601 | 719 | 735 | 113787 | 113803 | ATGGAACATCTGTCAGC | 9 | 727 |
| 740602 | 722 | 738 | 113790 | 113806 | AGGATGGAACATCTGTC | 19 | 728 |
| 740603 | 725 | 741 | 113793 | 113809 | TACAGGATGGAACATCT | 0 | 729 |
| 740604 | 730 | 746 | 113798 | 113814 | ACTTGTACAGGATGGAA | 55 | 730 |
| 740605 | 733 | 749 | 113801 | 113817 | AGCACTTGTACAGGATG | 61 | 731 |
| 740606 | 736 | 752 | 113804 | 113820 | CTGAGCACTTGTACAGG | 66 | 732 |
| 740607 | 739 | 755 | 113807 | 113823 | GAACTGAGCACTTGTAC | 49 | 733 |
| 740608 | 742 | 758 | 113810 | 113826 | TTGGAACTGAGCACTTG | 41 | 734 |
| 740609 | 745 | 761 | 113813 | 113829 | ACATTGGAACTGAGCAC | 36 | 735 |
| 740610 | 748 | 764 | 113816 | 113832 | GGCACATTGGAACTGAG | 47 | 736 |
| 740611 | 752 | 768 | 113820 | 113836 | ACTGGGCACATTGGAAC | 51 | 737 |
| 740612 | 755 | 771 | 113823 | 113839 | ATGACTGGGCACATTGG | 44 | 738 |
| 740613 | 758 | 774 | 113826 | 113842 | GTCATGACTGGGCACAT | 38 | 739 |
| 740614 | 761 | 777 | 113829 | 113845 | AATGTCATGACTGGGCA | 32 | 740 |
| 740615 | 764 | 780 | 113832 | 113848 | AGAAATGTCATGACTGG | 76 | 741 |
| 740616 | 767 | 783 | 113835 | 113851 | TTGAGAAATGTCATGAC | 54 | 742 |
| 740617 | 770 | 786 | 113838 | 113854 | ACTTTGAGAAATGTCAT | 34 | 743 |
| 740618 | 773 | 789 | 113841 | 113857 | AAAACTTTGAGAAATGT | 30 | 744 |
| 740619 | 776 | 792 | 113844 | 113860 | GTAAAACTTTGAGAAA | 69 | 745 |
| 740620 | 779 | 795 | 113847 | 113863 | ACTGTAAAACTTTGAG | 64 | 746 |
| 740621 | 782 | 798 | 113850 | 113866 | TACACTGTAAAACTTT | 39 | 747 |
| 740622 | 785 | 801 | 113853 | 113869 | AGATACACTGTAAAAC | 27 | 748 |
| 740623 | 786 | 802 | 113854 | 113870 | GAGATACACTGTAAAAA | 36 | 749 |
| 740624 | 787 | 803 | 113855 | 113871 | CGAGATACACTGTAAAA | 56 | 750 |

TABLE 12

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 11 | 21 |
| 740410 | 240 | 256 | 4691 | 4707 | GAATTCCTTTACACCAC | 89 | 33 |
| 740625 | 791 | 807 | 113859 | 113875 | ACTTCGAGATACACTGT | 76 | 751 |
| 740626 | 793 | 809 | 113861 | 113877 | AGACTTCGAGATACACT | 72 | 275 |
| 740627 | 795 | 811 | 113863 | 113879 | GAAGACTTCGAGATACA | 63 | 752 |
| 740628 | 796 | 812 | 113864 | 113880 | GGAAGACTTCGAGATAC | 71 | 427 |
| 740629 | 797 | 813 | 113865 | 113881 | TGGAAGACTTCGAGATA | 31 | 753 |
| 740630 | 799 | 815 | 113867 | 113883 | GATGGAAGACTTCGAGA | 50 | 754 |
| 740631 | 802 | 818 | 113870 | 113886 | GCTGATGGAAGACTTCG | 67 | 755 |
| 740632 | 805 | 821 | 113873 | 113889 | ACTGCTGATGGAAGACT | 73 | 756 |
| 740633 | 808 | 824 | 113876 | 113892 | ATCACTGCTGATGGAAG | 55 | 757 |
| 740634 | 812 | 828 | 113880 | 113896 | TTCAATCACTGCTGATG | 15 | 758 |
| 740635 | 815 | 831 | 113883 | 113899 | TACTTCAATCACTGCTG | 60 | 759 |
| 740636 | 818 | 834 | 113886 | 113902 | AGATACTTCAATCACTG | 72 | 760 |
| 740637 | 819 | 835 | 113887 | 113903 | CAGATACTTCAATCACT | 48 | 761 |
| 740638 | 820 | 836 | 113888 | 113904 | ACAGATACTTCAATCAC | 60 | 762 |
| 740639 | 821 | 837 | 113889 | 113905 | TACAGATACTTCAATCA | 38 | 763 |
| 740640 | 824 | 840 | 113892 | 113908 | AGGTACAGATACTTCAA | 63 | 764 |
| 740641 | 827 | 843 | 113895 | 113911 | GGCAGGTACAGATACTT | 45 | 765 |
| 740642 | 845 | 861 | 113913 | 113929 | ACCGAAATGCTGAGTGG | 63 | 766 |
| 740643 | 848 | 864 | 113916 | 113932 | AGCACCGAAATGCTGAG | 73 | 767 |
| 740644 | 851 | 867 | 113919 | 113935 | GGAAGCACCGAAATGCT | 48 | 768 |
| 740645 | 854 | 870 | 113922 | 113938 | AAGGGAAGCACCGAAAT | 46 | 769 |
| 740646 | 857 | 873 | 113925 | 113941 | TGAAAGGGAAGCACCGA | 34 | 770 |
| 740647 | 860 | 876 | 113928 | 113944 | CAGTGAAAGGGAAGCAC | 72 | 771 |
| 740648 | 863 | 879 | 113931 | 113947 | CTTCAGTGAAAGGGAAG | 21 | 772 |
| 740649 | 865 | 881 | 113933 | 113949 | CACTTCAGTGAAAGGGA | 75 | 773 |
| 740650 | 866 | 882 | 113934 | 113950 | TCACTTCAGTGAAAGGG | 79 | 49 |
| 740651 | 867 | 883 | 113935 | 113951 | TTCACTTCAGTGAAAGG | 31 | 774 |
| 740652 | 869 | 885 | 113937 | 113953 | TATTCACTTCAGTGAAA | 0 | 775 |
| 740653 | 870 | 886 | 113938 | 113954 | GTATTCACTTCAGTGAA | 35 | 776 |
| 740654 | 873 | 889 | 113941 | 113957 | CATGTATTCACTTCAGT | 78 | 777 |
| 740655 | 876 | 892 | 113944 | 113960 | TACCATGTATTCACTTC | 67 | 778 |
| 740656 | 879 | 895 | 113947 | 113963 | TGCTACCATGTATTCAC | 70 | 779 |
| 740657 | 882 | 898 | 113950 | 113966 | CCCTGCTACCATGTATT | 31 | 780 |
| 740658 | 885 | 901 | 113953 | 113969 | AGACCCTGCTACCATGT | 62 | 781 |
| 740659 | 886 | 902 | 113954 | 113970 | AAGACCCTGCTACCATG | 60 | 782 |

TABLE 12 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740660 | 890 | 906 | 113958 | 113974 | CACAAAGACCCTGCTAC | 4 | 783 |
| 740661 | 892 | 908 | 113960 | 113976 | CACACAAAGACCCTGCT | 29 | 50 |
| 740662 | 894 | 910 | 113962 | 113978 | AGCACACAAAGACCCTG | 70 | 784 |
| 740663 | 895 | 911 | 113963 | 113979 | CAGCACACAAAGACCCT | 66 | 202 |
| 740664 | 896 | 912 | 113964 | 113980 | ACAGCACACAAAGACCC | 47 | 785 |
| 740665 | 898 | 914 | 113966 | 113982 | CCACAGCACACAAAGAC | 61 | 786 |
| 740666 | 901 | 917 | 113969 | 113985 | AATCCACAGCACACAAA | 43 | 787 |
| 740667 | 905 | 921 | 113973 | 113989 | ACAAAATCCACAGCACA | 49 | 788 |
| 740668 | 911 | 927 | 113979 | 113995 | GAAGCCACAAAATCCAC | 80 | 789 |
| 740669 | 915 | 931 | 113983 | 113999 | GATTGAAGCCACAAAAT | 55 | 790 |
| 740670 | 918 | 934 | 113986 | 114002 | GTAGATTGAAGCCACAA | 86 | 791 |
| 740671 | 935 | 951 | 114003 | 114019 | TAATTTGTTTTAACATC | 49 | 792 |
| 740672 | 943 | 959 | 114011 | 114027 | GGTGTTTTAATTTGTT | 69 | 793 |
| 740673 | 944 | 960 | 114012 | 114028 | AGGTGTTTTAATTTGT | 72 | 128 |
| 740674 | 945 | 961 | 114013 | 114029 | TAGGTGTTTTAATTTG | 72 | 204 |
| 740675 | 946 | 962 | 114014 | 114030 | TTAGGTGTTTTAATTT | 47 | 794 |
| 740676 | 947 | 963 | 114015 | 114031 | CTTAGGTGTTTTAATT | 32 | 280 |
| 740677 | 950 | 966 | 114018 | 114034 | TCACTTAGGTGTTTTA | 0 | 795 |
| 740678 | 953 | 969 | 114021 | 114037 | TAGTCACTTAGGTGTTT | 9 | 796 |
| 740679 | 957 | 973 | 114025 | 114041 | GTGGTAGTCACTTAGGT | 19 | 797 |
| 740680 | 960 | 976 | 114028 | 114044 | TAAGTGGTAGTCACTTA | 0 | 798 |
| 740681 | 963 | 979 | 114031 | 114047 | AAATAAGTGGTAGTCAC | 55 | 799 |
| 740682 | 966 | 982 | 114034 | 114050 | TAGAAATAAGTGGTAGT | 61 | 800 |
| 740683 | 969 | 985 | 114037 | 114053 | ATTTAGAAATAAGTGGT | 66 | 801 |
| 740684 | 972 | 988 | 114040 | 114056 | AGGATTTAGAAATAAGT | 49 | 802 |
| 740685 | 975 | 991 | 114043 | 114059 | GTGAGGATTTAGAAATA | 41 | 803 |
| 740686 | 976 | 992 | 114044 | 114060 | AGTGAGGATTTAGAAAT | 36 | 804 |
| 740687 | 977 | 993 | 114045 | 114061 | TAGTGAGGATTTAGAAA | 47 | 805 |
| 740688 | 979 | 995 | 114047 | 114063 | AATAGTGAGGATTTAGA | 51 | 806 |
| 740689 | 982 | 998 | 114050 | 114066 | AAAATAGTGAGGATTT | 44 | 807 |
| 740690 | 985 | 1001 | 114053 | 114069 | CAAAAAATAGTGAGGA | 38 | 808 |
| 740691 | 989 | 1005 | 114057 | 114073 | GCAACAAAAAATAGTG | 32 | 809 |
| 740692 | 1002 | 1018 | 114070 | 114086 | CTTCTGAACAACAGCAA | 76 | 810 |
| 740693 | 1005 | 1021 | 114073 | 114089 | CAACTTCTGAACAACAG | 54 | 811 |
| 740694 | 1008 | 1024 | 114076 | 114092 | TAACAACTTCTGAACAA | 34 | 812 |
| 740695 | 1011 | 1027 | 114079 | 114095 | CACTAACAACTTCTGAA | 30 | 813 |

TABLE 12 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740696 | 1014 | 1030 | 114082 | 114098 | AATCACTAACAACTTCT | 69 | 814 |
| 740697 | 1017 | 1033 | 114085 | 114101 | GCAAATCACTAACAACT | 64 | 815 |
| 740698 | 1020 | 1036 | 114088 | 114104 | ATAGCAAATCACTAACA | 39 | 816 |
| 740699 | 1024 | 1040 | 114092 | 114108 | TATGATAGCAAATCACT | 27 | 817 |
| 740700 | 1027 | 1043 | 114095 | 114111 | ATATATGATAGCAAATC | 36 | 818 |
| 740701 | 1030 | 1046 | 114098 | 114114 | ATAATATATGATAGCAA | 56 | 819 |
| 740470 | 368 | 384 | 4819 | 4835 | CTACATAGAGAACACCC | 81 | 621 |

TABLE 13

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 387978 | 282 | 301 | 4733 | 4752 | TCCTTGGCCTTTGAAAGTCC | 18 | 21 |
| 740410 | 240 | 256 | 4691 | 4707 | GAATTCCTTTACACCAC | 84 | 33 |
| 740702 | 1033 | 1049 | 114101 | 114117 | CTTATAATATATGATAG | 16 | 820 |
| 740703 | 1036 | 1052 | 114104 | 114120 | AATCTTATAATATATGA | 27 | 821 |
| 740704 | 1041 | 1057 | 114109 | 114125 | CTAAAAATCTTATAATA | 0 | 822 |
| 740705 | 1044 | 1060 | 114112 | 114128 | CACCTAAAAATCTTATA | 11 | 823 |
| 740706 | 1047 | 1063 | 114115 | 114131 | AGACACCTAAAAATCTT | 49 | 824 |
| 740707 | 1048 | 1064 | 114116 | 114132 | AAGACACCTAAAAATCT | 25 | 825 |
| 740708 | 1049 | 1065 | 114117 | 114133 | AAAGACACCTAAAAATC | 27 | 826 |
| 740709 | 1052 | 1068 | 114120 | 114136 | TTAAAGACACCTAAAA | 6 | 827 |
| 740710 | 1055 | 1071 | 114123 | 114139 | TCATTAAAGACACCTA | 30 | 828 |
| 740711 | 1058 | 1074 | 114126 | 114142 | GTATCATTAAAAGACAC | 30 | 829 |
| 740712 | 1061 | 1077 | 114129 | 114145 | ACAGTATCATTAAAGA | 35 | 830 |
| 740713 | 1064 | 1080 | 114132 | 114148 | TAGACAGTATCATTAAA | 54 | 831 |
| 740714 | 1068 | 1084 | 114136 | 114152 | TTCTTAGACAGTATCAT | 57 | 832 |
| 740715 | 1071 | 1087 | 114139 | 114155 | TTATTCTTAGACAGTAT | 64 | 833 |
| 740716 | 1074 | 1090 | 114142 | 114158 | TCATTATTCTTAGACAG | 47 | 834 |
| 740717 | 1092 | 1108 | 114160 | 114176 | AACAAATTTCACAATAC | 60 | 835 |
| 740718 | 1095 | 1111 | 114163 | 114179 | ATTAACAAATTTCACAA | 34 | 836 |
| 740719 | 1106 | 1122 | 114174 | 114190 | GTATTATATATATTAAC | 32 | 837 |
| 740720 | 1121 | 1137 | 114189 | 114205 | CTCACATATTTTTAAGT | 44 | 838 |
| 740721 | 1124 | 1140 | 114192 | 114208 | ATGCTCACATATTTTTA | 45 | 839 |
| 740722 | 1127 | 1143 | 114195 | 114211 | TTCATGCTCACATATTT | 40 | 840 |
| 740723 | 1130 | 1146 | 114198 | 114214 | AGTTTCATGCTCACATA | 67 | 841 |

TABLE 13 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740724 | 1134 | 1150 | 114202 | 114218 | GCATAGTTTCATGCTCA | 51 | 842 |
| 740725 | 1137 | 1153 | 114205 | 114221 | GGTGCATAGTTTCATGC | 46 | 843 |
| 740726 | 1138 | 1154 | 114206 | 114222 | AGGTGCATAGTTTCATG | 54 | 844 |
| 740727 | 1140 | 1156 | 114208 | 114224 | ATAGGTGCATAGTTTCA | 63 | 845 |
| 740728 | 1143 | 1159 | 114211 | 114227 | TTTATAGGTGCATAGTT | 62 | 846 |
| 740729 | 1146 | 1162 | 114214 | 114230 | GTATTTATAGGTGCATA | 67 | 847 |
| 740730 | 1149 | 1165 | 114217 | 114233 | TTAGTATTTATAGGTGC | 72 | 848 |
| 740731 | 1152 | 1168 | 114220 | 114236 | TATTTAGTATTTATAGG | 32 | 849 |
| 740732 | 1164 | 1180 | 114232 | 114248 | GGTAAAATTTCATATTT | 33 | 850 |
| 740733 | 1173 | 1189 | 114241 | 114257 | TCGCAAAATGGTAAAAT | 49 | 851 |
| 740734 | 1176 | 1192 | 114244 | 114260 | ACATCGCAAAATGGTAA | 62 | 852 |
| 740735 | 1179 | 1195 | 114247 | 114263 | AACACATCGCAAAATGG | 42 | 853 |
| 740736 | 1182 | 1198 | 114250 | 114266 | TAAAACACATCGCAAAA | 28 | 854 |
| 740737 | 1185 | 1201 | 114253 | 114269 | GAATAAAACACATCGCA | 62 | 855 |
| 740738 | 1188 | 1204 | 114256 | 114272 | AGTGAATAAAACACATC | 16 | 856 |
| 740739 | 1191 | 1207 | 114259 | 114275 | ACAAGTGAATAAAACAC | 64 | 857 |
| 740740 | 1196 | 1212 | 114264 | 114280 | CAAACACAAGTGAATAA | 16 | 858 |
| 740741 | 1199 | 1215 | 114267 | 114283 | ATACAAACACAAGTGAA | 33 | 859 |
| 740742 | 1203 | 1219 | 114271 | 114287 | TTATATACAAACACAAG | 31 | 860 |
| 740743 | 1207 | 1223 | 114275 | 114291 | CCATTTATATACAAACA | 28 | 861 |
| 740744 | 1210 | 1226 | 114278 | 114294 | TCACCATTTATATACAA | 53 | 862 |
| 740745 | 1214 | 1230 | 114282 | 114298 | ATTCTCACCATTTATAT | 40 | 863 |
| 740746 | 1222 | 1238 | 114290 | 114306 | TTATTTTAATTCTCACC | 46 | 864 |
| 740747 | 1242 | 1258 | 114310 | 114326 | TTTTGCAATGAGATAAC | 0 | 865 |
| 740748 | 1245 | 1261 | 114313 | 114329 | TATTTTTGCAATGAGAT | 42 | 866 |
| 740749 | 1265 | 1281 | 114333 | 114349 | GAGATGGGATAAAAATA | 38 | 867 |
| 740750 | 1268 | 1284 | 114336 | 114352 | AGTGAGATGGGATAAAA | 32 | 868 |
| 740751 | 1271 | 1287 | 114339 | 114355 | TAAAGTGAGATGGGATA | 30 | 869 |
| 740752 | 1275 | 1291 | 114343 | 114359 | TTATTAAAGTGAGATGG | 24 | 870 |
| 740753 | 1278 | 1294 | 114346 | 114362 | TTATTATTAAAGTGAGA | 9 | 871 |
| 740754 | 1288 | 1304 | 114356 | 114372 | AGCATGATTTTTATTAT | 36 | 872 |

TABLE 13 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740755 | 1291 | 1307 | 114359 | 114375 | ATAAGCATGATTTTTAT | 2 | 873 |
| 740756 | 1292 | 1308 | 114360 | 114376 | TATAAGCATGATTTTTA | 25 | 874 |
| 740757 | 1296 | 1312 | 114364 | 114380 | TGCTTATAAGCATGATT | 20 | 875 |
| 740758 | 1299 | 1315 | 114367 | 114383 | TGTTGCTTATAAGCATG | 0 | 876 |
| 740759 | 1302 | 1318 | 114370 | 114386 | TCATGTTGCTTATAAGC | 27 | 877 |
| 740760 | 1306 | 1322 | 114374 | 114390 | TAATTCATGTTGCTTAT | 55 | 878 |
| 740761 | 1309 | 1325 | 114377 | 114393 | TCTTAATTCATGTTGCT | 35 | 879 |
| 740762 | 1312 | 1328 | 114380 | 114396 | AGTTCTTAATTCATGTT | 41 | 880 |
| 740763 | 1315 | 1331 | 114383 | 114399 | GTCAGTTCTTAATTCAT | 54 | 881 |
| 740764 | 1318 | 1334 | 114386 | 114402 | TGTGTCAGTTCTTAATT | 61 | 882 |
| 740765 | 1321 | 1337 | 114389 | 114405 | CTTTGTGTCAGTTCTTA | 68 | 883 |
| 740766 | 1324 | 1340 | 114392 | 114408 | GTCCTTTGTGTCAGTTC | 64 | 884 |
| 740767 | 1328 | 1344 | 114396 | 114412 | TTTTGTCCTTTGTGTCA | 30 | 885 |
| 740768 | 1331 | 1347 | 114399 | 114415 | TATTTTTGTCCTTTGTG | 36 | 886 |
| 740769 | 1336 | 1352 | 114404 | 114420 | CTTTATATTTTTGTCCT | 13 | 887 |
| 740770 | 1346 | 1362 | 114414 | 114430 | CTATTAATAACTTTATA | 15 | 888 |
| 740771 | 1349 | 1365 | 114417 | 114433 | TGGCTATTAATAACTTT | 43 | 889 |
| 740772 | 1352 | 1368 | 114420 | 114436 | AAATGGCTATTAATAAC | 36 | 890 |
| 740773 | 1355 | 1371 | 114423 | 114439 | TTCAAATGGCTATTAAT | 35 | 891 |
| 740774 | 1358 | 1374 | 114426 | 114442 | TTCTTCAAATGGCTATT | 40 | 892 |
| 740775 | 1361 | 1377 | 114429 | 114445 | TCCTTCTTCAAATGGCT | 45 | 893 |
| 740776 | 1364 | 1380 | 114432 | 114448 | TCCTCCTTCTTCAAATG | 8 | 894 |
| 740777 | 1369 | 1385 | 114437 | 114453 | AAAATTCCTCCTTCTTC | 39 | 895 |
| 740778 | 1372 | 1388 | 114440 | 114456 | TCTAAAATTCCTCCTTC | 33 | 896 |

Example 3: Effect of 4-9-4 MOE and cEt Gapmers with Mixed Internucleoside Linkages on Human SNCA In Vitro, Single Dose Modified oligonucleotides complementary to a human SNCA nucleic acid were designed and tested as described in Example 1 for their effect on SNCA mRNA in vitro. The modified oligonucleotides were tested in a series of experiments that had similar culture conditions.

The modified oligonucleotides in tables 14-23 are 4-9-4 MOE and cEt gapmers. The gapmers are 17 nucleobases in length, wherein the central gap segment comprises nine 2'-deoxynucleosides and is flanked by wing segments on both the 5' end on the 3' end comprising two 2'-MOE nucleosides and two cEt nucleosides. The sugar motif for the gapmers is (from 5' to 3'): eekkddddddddkkee; wherein 'd' represents a 2'-deoxyribose sugar; 'e' represents a 2'-MOE modified sugar; and 'k' represents a cEt modified sugar. All cytosine residues throughout each gapmer are 5-methyl cytosines. The internucleoside linkages are mixed phosphodiester and phosphorothioate linkages. The internucleoside linkage motif for the gapmers is (from 5' to 3'): sooosssssssssoss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the Tables below is complementary to human SNCA nucleic acid sequences SEQ ID NO: 1, SEQ ID NO: 2, SEQ ID NO: 3, SEQ ID NO: 4, SEQ ID NO: 5, or SEQ ID NO: 6, as indicated. 'N/A' indicates that the modified oligonucleotide is not complementary to that particular nucleic acid with 100% complementarity. A value of 0% reduction indicates that the compound had no effect or increased mRNA concentrations in the cell. As shown below, modified oligonucleotides complementary to human SNCA reduced the amount of human SNCA mRNA.

TABLE 14

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 97 | 33 |
| 740432 | 270 | 286 | 4721 | 4737 | AGTCCTTTCATGAATAC | 95 | 591 |
| 740779 | 1375 | 1391 | 114443 | 114459 | TCTTCTAAAATTCCTCC | 51 | 897 |
| 740780 | 1378 | 1394 | 114446 | 114462 | ACCTCTTCTAAAATTCC | 45 | 898 |
| 740781 | 1381 | 1397 | 114449 | 114465 | TCTACCTCTTCTAAAAT | 7 | 899 |
| 740782 | 1384 | 1400 | 114452 | 114468 | TTCTCTACCTCTTCTAA | 41 | 900 |
| 740783 | 1389 | 1405 | 114457 | 114473 | CCATTTTCTCTACCTCT | 90 | 901 |
| 740784 | 1392 | 1408 | 114460 | 114476 | GTTCCATTTTCTCTACC | 78 | 902 |
| 740785 | 1396 | 1412 | 114464 | 114480 | TAATGTTCCATTTTCTC | 62 | 903 |
| 740786 | 1400 | 1416 | 114468 | 114484 | GGGTTAATGTTCCATTT | 65 | 904 |
| 740787 | 1403 | 1419 | 114471 | 114487 | GTAGGGTTAATGTTCCA | 74 | 905 |
| 740788 | 1406 | 1422 | 114474 | 114490 | AGTGTAGGGTTAATGTT | 44 | 906 |
| 740789 | 1409 | 1425 | 114477 | 114493 | CCGAGTGTAGGGTTAAT | 70 | 907 |
| 740790 | 1412 | 1428 | 114480 | 114496 | ATTCCGAGTGTAGGGTT | 76 | 908 |
| 740791 | 1415 | 1431 | 114483 | 114499 | GGAATTCCGAGTGTAGG | 22 | 909 |
| 740792 | 1418 | 1434 | 114486 | 114502 | CAGGGAATTCCGAGTGT | 75 | 910 |
| 740793 | 1422 | 1438 | 114490 | 114506 | GCTTCAGGGAATTCCGA | 68 | 911 |
| 740794 | 1425 | 1441 | 114493 | 114509 | GTTGCTTCAGGGAATTC | 84 | 912 |
| 740795 | 1428 | 1444 | 114496 | 114512 | AGTGTTGCTTCAGGGAA | 76 | 913 |
| 740796 | 1431 | 1447 | 114499 | 114515 | GGCAGTGTTGCTTCAGG | 82 | 914 |
| 740797 | 1434 | 1450 | 114502 | 114518 | TCTGGCAGTGTTGCTTC | 55 | 915 |
| 740798 | 1437 | 1453 | 114505 | 114521 | ACTTCTGGCAGTGTTGC | 63 | 916 |
| 740799 | 1440 | 1456 | 114508 | 114524 | CACACTTCTGGCAGTGT | 19 | 917 |
| 740800 | 1444 | 1460 | 114512 | 114528 | AAAACACACTTCTGGCA | 50 | 918 |
| 740801 | 1447 | 1463 | 114515 | 114531 | ACCAAAACACACTTCTG | 87 | 919 |
| 740802 | 1450 | 1466 | 114518 | 114534 | CATACCAAAACACACTT | 87 | 920 |
| 740803 | 1453 | 1469 | 114521 | 114537 | GTGCATACCAAAACACA | 31 | 921 |
| 740804 | 1456 | 1472 | 114524 | 114540 | CCAGTGCATACCAAAAC | 77 | 922 |
| 740805 | 1459 | 1475 | 114527 | 114543 | GAACCAGTGCATACCAA | 67 | 923 |
| 740806 | 1462 | 1478 | 114530 | 114546 | AAGGAACCAGTGCATAC | 69 | 924 |
| 740807 | 1466 | 1482 | 114534 | 114550 | ACTTAAGGAACCAGTGC | 49 | 925 |
| 740808 | 1469 | 1485 | 114537 | 114553 | GCCACTTAAGGAACCAG | 82 | 926 |
| 740809 | 1472 | 1488 | 114540 | 114556 | ACAGCCACTTAAGGAAC | 64 | 927 |
| 740810 | 1475 | 1491 | 114543 | 114559 | ATCACAGCCACTTAAGG | 28 | 928 |
| 740811 | 1478 | 1494 | 114546 | 114562 | TTAATCACAGCCACTTA | 62 | 929 |
| 740812 | 1481 | 1497 | 114549 | 114565 | TAATTAATCACAGCCAC | 67 | 930 |
| 740813 | 1484 | 1500 | 114552 | 114568 | CAATAATTAATCACAGC | 74 | 931 |

TABLE 14 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740814 | 1488 | 1504 | 114556 | 114572 | CTTTCAATAATTAATCA | 22 | 932 |
| 740815 | 1492 | 1508 | 114560 | 114576 | CCCACTTTCAATAATTA | 20 | 933 |
| 740816 | 1521 | 1537 | 114589 | 114605 | TCTACAATAGTAGTTGG | 23 | 934 |
| 740817 | 1524 | 1540 | 114592 | 114608 | CACTCTACAATAGTAGT | 37 | 935 |
| 740818 | 1527 | 1543 | 114595 | 114611 | GACCACTCTACAATAGT | 62 | 936 |
| 740819 | 1530 | 1546 | 114598 | 114614 | ATAGACCACTCTACAAT | 55 | 937 |
| 740820 | 1533 | 1549 | 114601 | 114617 | GAAATAGACCACTCTAC | 50 | 938 |
| 740821 | 1536 | 1552 | 114604 | 114620 | GGAGAAATAGACCACTC | 64 | 939 |
| 740822 | 1545 | 1561 | 114613 | 114629 | GGATTGAAGGGAGAAAT | 49 | 940 |
| 740823 | 1548 | 1564 | 114616 | 114632 | ACAGGATTGAAGGGAGA | 71 | 941 |
| 740824 | 1551 | 1567 | 114619 | 114635 | TTGACAGGATTGAAGGG | 57 | 942 |
| 740825 | 1554 | 1570 | 114622 | 114638 | ACATTGACAGGATTGAA | 58 | 943 |
| 740826 | 1557 | 1573 | 114625 | 114641 | CAAACATTGACAGGATT | 62 | 944 |
| 740827 | 1580 | 1596 | 114648 | 114664 | ACAGTTCCCCAAAATAC | 50 | 945 |
| 740828 | 1583 | 1599 | 114651 | 114667 | ACAACAGTTCCCCAAAA | 6 | 946 |
| 740829 | 1586 | 1602 | 114654 | 114670 | CAAACAACAGTTCCCCA | 43 | 947 |
| 740830 | 1589 | 1605 | 114657 | 114673 | CATCAAACAACAGTTCC | 48 | 948 |
| 740831 | 1592 | 1608 | 114660 | 114676 | ACACATCAAACAACAGT | 68 | 949 |
| 740832 | 1595 | 1611 | 114663 | 114679 | CATACACATCAAACAAC | 24 | 950 |
| 740833 | 1627 | 1643 | 114695 | 114711 | GCTCAATTAAAAATGTA | 31 | 951 |
| 740834 | 1630 | 1646 | 114698 | 114714 | AAGGCTCAATTAAAAAT | 26 | 952 |
| 740835 | 1637 | 1653 | 114705 | 114721 | TTAATAAAAGGCTCAAT | 28 | 953 |
| 740836 | 1640 | 1656 | 114708 | 114724 | ATGTTAATAAAAGGCTC | 57 | 954 |
| 740837 | 1647 | 1663 | 114715 | 114731 | ACAATATATGTTAATAA | 3 | 955 |
| 740838 | 1661 | 1677 | 114729 | 114745 | TCGAGACAAAATAACA | 29 | 956 |
| 740839 | 1664 | 1680 | 114732 | 114748 | ATTTCGAGACAAAATA | 33 | 957 |
| 740840 | 1667 | 1683 | 114735 | 114751 | ATTATTTCGAGACAAAA | 34 | 958 |
| 740841 | 1670 | 1686 | 114738 | 114754 | AAAATTATTTCGAGACA | 47 | 959 |
| 740842 | 1673 | 1689 | 114741 | 114757 | TAAAAATTATTTCGAG | 11 | 960 |
| 740843 | 1685 | 1701 | 114753 | 114769 | ATAGATTTTAACTAAAA | 0 | 961 |
| 740844 | 1706 | 1722 | 114774 | 114790 | TTCACACCAATATCAGA | 64 | 962 |
| 740845 | 1709 | 1725 | 114777 | 114793 | GCATTCACACCAATATC | 55 | 963 |
| 740846 | 1712 | 1728 | 114780 | 114796 | ACAGCATTCACACCAAT | 73 | 964 |
| 740847 | 1715 | 1731 | 114783 | 114799 | GGTACAGCATTCACACC | 46 | 965 |
| 740848 | 1718 | 1734 | 114786 | 114802 | AAAGGTACAGCATTCAC | 65 | 966 |
| 740849 | 1721 | 1737 | 114789 | 114805 | CAGAAAGGTACAGCATT | 56 | 967 |

TABLE 14 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740850 | 1724 | 1740 | 114792 | 114808 | TGTCAGAAAGGTACAGC | 49 | 968 |
| 740851 | 1728 | 1744 | 114796 | 114812 | TTATTGTCAGAAAGGTA | 79 | 969 |
| 740852 | 1731 | 1747 | 114799 | 114815 | TATTTATTGTCAGAAAG | 52 | 970 |
| 740853 | 1734 | 1750 | 114802 | 114818 | TATTATTTATTGTCAGA | 79 | 971 |
| 740854 | 1737 | 1753 | 114805 | 114821 | GAATATTATTTATTGTC | 54 | 972 |
| 740855 | 1741 | 1757 | 114809 | 114825 | GGTCGAATATTATTTAT | 51 | 973 |

TABLE 15

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 91 | 33 |
| 740432 | 270 | 286 | 4721 | 4737 | AGTCCTTTCATGAATAC | 79 | 591 |
| 740856 | 1745 | 1761 | 114813 | 114829 | TCATGGTCGAATATTAT | 31 | 974 |
| 740857 | 1748 | 1764 | 114816 | 114832 | TATTCATGGTCGAATAT | 24 | 975 |
| 740858 | 1751 | 1767 | 114819 | 114835 | TTTTATTCATGGTCGAA | 62 | 976 |
| 740859 | 1754 | 1770 | 114822 | 114838 | TTTTTTTATTCATGGTC | 77 | 977 |
| 740860 | 1771 | 1787 | 114839 | 114855 | GGAACCCACTTTTTTT | 14 | 978 |
| 740861 | 1774 | 1790 | 114842 | 114858 | CCGGGAACCCACTTTTT | 25 | 979 |
| 740862 | 1777 | 1793 | 114845 | 114861 | TTCCCGGGAACCCACTT | 20 | 980 |
| 740863 | 1780 | 1796 | 114848 | 114864 | TAGTTCCCGGGAACCCA | 25 | 981 |
| 740864 | 1784 | 1800 | 114852 | 114868 | TGCTTAGTTCCCGGGAA | 25 | 982 |
| 740865 | 1787 | 1803 | 114855 | 114871 | CACTGCTTAGTTCCCGG | 51 | 983 |
| 740866 | 1790 | 1806 | 114858 | 114874 | CTACACTGCTTAGTTCC | 76 | 984 |
| 740867 | 1793 | 1809 | 114861 | 114877 | CTTCTACACTGCTTAGT | 37 | 985 |
| 740868 | 1796 | 1812 | 114864 | 114880 | CATCTTCTACACTGCTT | 54 | 986 |
| 740869 | 1799 | 1815 | 114867 | 114883 | AATCATCTTCTACACTG | 38 | 987 |
| 740870 | 1802 | 1818 | 114870 | 114886 | CAAAATCATCTTCTACA | 17 | 988 |
| 740871 | 1806 | 1822 | 114874 | 114890 | TAGTCAAAATCATCTTC | 40 | 989 |
| 740872 | 1809 | 1825 | 114877 | 114893 | GTGTAGTCAAAATCATC | 58 | 990 |
| 740873 | 1812 | 1828 | 114880 | 114896 | AGGGTGTAGTCAAAATC | 61 | 991 |
| 740874 | 1815 | 1831 | 114883 | 114899 | AGGAGGGTGTAGTCAAA | 43 | 992 |
| 740875 | 1818 | 1834 | 114886 | 114902 | CTAAGGAGGGTGTAGTC | 41 | 993 |
| 740876 | 1821 | 1837 | 114889 | 114905 | TCTCTAAGGAGGGTGTA | 43 | 994 |
| 740877 | 1824 | 1840 | 114892 | 114908 | GGCTCTCTAAGGAGGGT | 38 | 995 |
| 740878 | 1828 | 1844 | 114896 | 114912 | TTATGGCTCTCTAAGGA | 37 | 996 |

TABLE 15 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740879 | 1831 | 1847 | 114899 | 114915 | GTCTTATGGCTCTCTAA | 66 | 997 |
| 740880 | 1834 | 1850 | 114902 | 114918 | TGTGTCTTATGGCTCTC | 72 | 998 |
| 740881 | 1837 | 1853 | 114905 | 114921 | TAATGTGTCTTATGGCT | 67 | 999 |
| 740882 | 1840 | 1856 | 114908 | 114924 | TGCTAATGTGTCTTATG | 59 | 1000 |
| 740883 | 1843 | 1859 | 114911 | 114927 | ATGTGCTAATGTGTCTT | 66 | 1001 |
| 740884 | 1846 | 1862 | 114914 | 114930 | AATATGTGCTAATGTGT | 74 | 1002 |
| 740885 | 1850 | 1866 | 114918 | 114934 | TGCTAATATGTGCTAAT | 33 | 1003 |
| 740886 | 1853 | 1869 | 114921 | 114937 | ATGTGCTAATATGTGCT | 34 | 1004 |
| 740887 | 1856 | 1872 | 114924 | 114940 | TGAATGTGCTAATATGT | 52 | 1005 |
| 740888 | 1859 | 1875 | 114927 | 114943 | CCTTGAATGTGCTAATA | 59 | 1006 |
| 740889 | 1862 | 1878 | 114930 | 114946 | GAGCCTTGAATGTGCTA | 28 | 1007 |
| 740890 | 1865 | 1881 | 114933 | 114949 | TCAGAGCCTTGAATGTG | 52 | 1008 |
| 740891 | 1868 | 1884 | 114936 | 114952 | CTCTCAGAGCCTTGAAT | 48 | 1009 |
| 740892 | 1870 | 1886 | 114938 | 114954 | TTCTCTCAGAGCCTTGA | 74 | 1010 |
| 740893 | 1871 | 1887 | 114939 | 114955 | ATTCTCTCAGAGCCTTG | 83 | 444 |
| 740894 | 1872 | 1888 | 114940 | 114956 | CATTCTCTCAGAGCCTT | 80 | 1011 |
| 740895 | 1874 | 1890 | 114942 | 114958 | CACATTCTCTCAGAGCC | 57 | 1012 |
| 740896 | 1875 | 1891 | 114943 | 114959 | CCACATTCTCTCAGAGC | 57 | 1013 |
| 740897 | 1995 | 2011 | 115063 | 115079 | TAAAGGCATTTCCTGTA | 50 | 1014 |
| 740898 | 2081 | 2097 | 115149 | 115165 | GGCAACATTTAAAGGAG | 46 | 1015 |
| 740899 | 2251 | 2267 | 115319 | 115335 | GAAATGACTATGCCCCA | 61 | 1016 |
| 740900 | 2312 | 2328 | 115380 | 115396 | AAACTGCTAGCATGTCT | 62 | 1017 |
| 740901 | 2437 | 2453 | 115505 | 115521 | TGTAGTAGTCTCTCTTC | 77 | 1018 |
| 740902 | 2841 | 2857 | 115909 | 115925 | TGTTTAAGTGTTTGGTC | 79 | 1019 |
| 740903 | 2939 | 2955 | 116007 | 116023 | GGACTGGATTGATCCTC | 48 | 1020 |
| 740904 | 3158 | 3174 | 116226 | 116242 | ACATACTGGATAAGCCA | 83 | 1021 |
| 740905 | N/A | N/A | 2087 | 2103 | CCTGGATCACACCAGAA | 28 | 1022 |
| 740906 | N/A | N/A | 2090 | 2106 | GTTCCTGGATCACACCA | 45 | 1023 |
| 740907 | N/A | N/A | 2093 | 2109 | GCTGTTCCTGGATCACA | 41 | 1024 |
| 740908 | N/A | N/A | 2096 | 2112 | ACAGCTGTTCCTGGATC | 2 | 1025 |
| 740909 | N/A | N/A | 2099 | 2115 | AAGACAGCTGTTCCTGG | 19 | 1026 |
| 740910 | N/A | N/A | 2102 | 2118 | TGGAAGACAGCTGTTCC | 7 | 1027 |
| 740911 | N/A | N/A | 2105 | 2121 | AGCTGGAAGACAGCTGT | 13 | 1028 |
| 740912 | N/A | N/A | 2108 | 2124 | CAGAGCTGGAAGACAGC | 26 | 1029 |
| 740913 | N/A | N/A | 2113 | 2129 | TCTTTCAGAGCTGGAAG | 16 | 1030 |

TABLE 16

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 97 | 33 |
| 740432 | 270 | 286 | 4721 | 4737 | AGTCCTTTCATGAATAC | 92 | 591 |
| 740933 | N/A | N/A | 3624 | 3640 | CCTGAGTCCCTCTGCTT | 27 | 1031 |
| 740934 | N/A | N/A | 3849 | 3865 | TAATCTCTCAGCCCTTG | 55 | 1032 |
| 740935 | N/A | N/A | 4074 | 4090 | CCACCCTAGCGGACCCC | 35 | 1033 |
| 740936 | N/A | N/A | 4299 | 4315 | CCAGAAGAAGGCTAACA | 35 | 1034 |
| 740937 | N/A | N/A | 4524 | 4540 | GGCATTAAAAATTTAGC | 68 | 1035 |
| 740938 | N/A | N/A | 4684 | 4700 | TTTACACCACACTGGAA | 65 | 1036 |
| 740939 | N/A | N/A | 4685 | 4701 | CTTTACACCACACTGGA | 82 | 1037 |
| 740940 | N/A | N/A | 4686 | 4702 | CCTTTACACCACACTGG | 68 | 1038 |
| 740941 | N/A | N/A | 4821 | 4837 | ACCTACATAGAGAACAC | 83 | 1039 |
| 740942 | N/A | N/A | 5046 | 5062 | GGCAAAATTAAAAATCT | 38 | 1040 |
| 740943 | N/A | N/A | 5275 | 5291 | TTATACACATCACAGGG | 59 | 1041 |
| 740944 | N/A | N/A | 5500 | 5516 | AAGGTGGAACTTTAGGA | 73 | 1042 |
| 740945 | N/A | N/A | 5725 | 5741 | GACTCTTACTGCTATAG | 47 | 1043 |
| 740946 | N/A | N/A | 5984 | 6000 | TGATAGCATCACTGCAG | 13 | 1044 |
| 740947 | N/A | N/A | 6209 | 6225 | AACTCATCAATTTTTTC | 67 | 1045 |
| 740948 | N/A | N/A | 6439 | 6455 | GTAACCAATAAAAAATT | 24 | 1046 |
| 740949 | N/A | N/A | 6715 | 6731 | GTTGTTTGTAGACACAG | 54 | 1047 |
| 740950 | N/A | N/A | 6940 | 6956 | TGTTTATGACTACCTTC | 62 | 1048 |
| 740951 | N/A | N/A | 7165 | 7181 | ATTTTTTACTAATCAGG | 38 | 1049 |
| 740952 | N/A | N/A | 7615 | 7631 | GTCATTTGAAGAAATTT | 60 | 1050 |
| 740953 | N/A | N/A | 7840 | 7856 | GTGCATGTTATGTTGAC | 36 | 1051 |
| 740954 | N/A | N/A | 8065 | 8081 | TTATGAGTAATCTGTAA | 30 | 1052 |
| 740955 | N/A | N/A | 8290 | 8306 | GCCACTAAACCACACCA | 65 | 1053 |
| 740956 | N/A | N/A | 8544 | 8560 | GGGATGATGAGATCAGG | 40 | 1054 |
| 740957 | N/A | N/A | 8769 | 8785 | TTTTAGCTGCCCTTGCC | 25 | 1055 |
| 740958 | N/A | N/A | 8995 | 9011 | TTATCTCACATATATGT | 30 | 1056 |
| 740959 | N/A | N/A | 9240 | 9256 | ACACCACTCCATTGCAG | 46 | 1057 |
| 740960 | N/A | N/A | 9465 | 9481 | GGAGTGGACATGTTTTT | 43 | 1058 |
| 740961 | N/A | N/A | 9691 | 9707 | CAACACAGTGGCTCTTG | 24 | 1059 |
| 740962 | N/A | N/A | 9920 | 9936 | GAATGATAAATGTTTCA | 32 | 1060 |
| 740963 | N/A | N/A | 10146 | 10162 | AGATAGAAGTAGAGAGT | 14 | 1061 |
| 740964 | N/A | N/A | 10371 | 10387 | TTGTTTGTGCTGGAACT | 16 | 1062 |
| 740965 | N/A | N/A | 10596 | 10612 | CATAACAGATGTGAAGC | 45 | 1063 |
| 740966 | N/A | N/A | 10821 | 10837 | TGCAGCAGTGACAACAT | 73 | 1064 |
| 740967 | N/A | N/A | 11046 | 11062 | TTTACAGAATTATCATA | 37 | 1065 |

TABLE 16 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740968 | N/A | N/A | 11271 | 11287 | CATTACACATGTAATAA | 6 | 1066 |
| 740969 | N/A | N/A | 11729 | 11745 | CATTATGTAAAAAAAC | 0 | 1067 |
| 740970 | N/A | N/A | 11954 | 11970 | TACGATTTTAGCACAAA | 68 | 1068 |
| 740971 | N/A | N/A | 12182 | 12198 | CCTACAAAAACAAATTC | 0 | 1069 |
| 740972 | N/A | N/A | 12192 | 12208 | GGTTTTGGAGCCTACAA | 83 | 1070 |
| 740973 | N/A | N/A | 12421 | 12437 | GCAAGTATATTTTTAT | 62 | 1071 |
| 740974 | N/A | N/A | 12646 | 12662 | CCTGAAATGCACTCTGA | 54 | 1072 |
| 740975 | N/A | N/A | 12871 | 12887 | CTCATCTTCCTCAACAT | 56 | 1073 |
| 740976 | N/A | N/A | 13098 | 13114 | TCCATTTTAGAAGTCAG | 87 | 1074 |
| 740977 | N/A | N/A | 13331 | 13347 | TAACACTTATAAAATAC | 44 | 1075 |
| 740978 | N/A | N/A | 13556 | 13572 | GAGGTCCCTAGAAGGCA | 38 | 1076 |
| 740979 | N/A | N/A | 13781 | 13797 | TCTCCATTAGATCATCA | 43 | 1077 |
| 740980 | N/A | N/A | 14011 | 14027 | GAGAAAATAAAGTATAC | 41 | 1078 |
| 740981 | N/A | N/A | 14236 | 14252 | TGGTCCATGGGTGCAAT | 52 | 1079 |
| 740982 | N/A | N/A | 14461 | 14477 | ATATGCAAATTATTCTC | 40 | 1080 |
| 740983 | N/A | N/A | 14686 | 14702 | TTCCCAGCCCAAGTTTA | 1 | 1081 |
| 740984 | N/A | N/A | 14911 | 14927 | AATAGGTAACTTTATAT | 19 | 1082 |
| 740985 | N/A | N/A | 15136 | 15152 | TAATATATGGTTTTGAA | 28 | 1083 |
| 740986 | N/A | N/A | 15365 | 15381 | GGATTCTGCTTTATTTT | 51 | 1084 |
| 740987 | N/A | N/A | 15590 | 15606 | CGACACATTTAAAAACA | 36 | 1085 |
| 740988 | N/A | N/A | 15815 | 15831 | AAAGCGAGATTAAAAAT | 0 | 1086 |
| 740989 | N/A | N/A | 16040 | 16056 | GGATATGGCTGATGTCT | 13 | 1087 |
| 740990 | N/A | N/A | 16265 | 16281 | CCAATATTTAAATGGTG | 34 | 1088 |
| 740991 | N/A | N/A | 16591 | 16607 | GCCAATATTTACTTATT | 61 | 1089 |
| 740992 | N/A | N/A | 16818 | 16834 | TCATGTGGAATCTAAAG | 6 | 1090 |
| 740993 | N/A | N/A | 17043 | 17059 | AGTATGAAAATGAAGAG | 38 | 1091 |
| 740994 | N/A | N/A | 17501 | 17517 | ATTCTTGTTGTTCAGGC | 73 | 1092 |
| 740995 | N/A | N/A | 17726 | 17742 | GGAATGTAAAGCCATGA | 78 | 1093 |
| 740996 | N/A | N/A | 17951 | 17967 | ATTAAAGGGTGGTAGAA | 26 | 1094 |
| 740997 | N/A | N/A | 18176 | 18192 | AATGAACCGTAATCTCA | 87 | 1095 |
| 740998 | N/A | N/A | 18296 | 18312 | CTGGGTTAATGCCTGAA | 60 | 1096 |
| 740999 | N/A | N/A | 18297 | 18313 | TCTGGGTTAATGCCTGA | 67 | 163 |
| 741000 | N/A | N/A | 18298 | 18314 | ATCTGGGTTAATGCCTG | 86 | 1097 |
| 741001 | N/A | N/A | 18401 | 18417 | GAAATGTCACTGTTCCT | 97 | 1098 |
| 741002 | N/A | N/A | 18626 | 18642 | GGTTGGTATGTATTTTA | 92 | 1099 |
| 741003 | N/A | N/A | 18851 | 18867 | CAAGGAGGTCATTGTGG | 75 | 1100 |

TABLE 16 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741004 | N/A | N/A | 19183 | 19199 | CTTTGGCAAAGAAAGGA | 45 | 1101 |
| 741005 | N/A | N/A | 19408 | 19424 | AAATGAAAGTTGTTGTG | 85 | 1102 |
| 741006 | N/A | N/A | 19633 | 19649 | GATATTTTGTTCTGCC | 95 | 1103 |
| 741007 | N/A | N/A | 19868 | 19884 | GCTATAAATAGAATTAA | 42 | 1104 |
| 741008 | N/A | N/A | 20099 | 20115 | TAGATTTCTGTTTCCTC | 94 | 1105 |
| 741009 | N/A | N/A | 20324 | 20340 | AATGCAGGTGAATAAAA | 81 | 1106 |

TABLE 17

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 92 | 33 |
| 740432 | 270 | 286 | 4721 | 4737 | AGTCCTTTCATGAATAC | 87 | 591 |
| 741010 | N/A | N/A | 20549 | 20565 | CAATTTCTAGGTTCTAT | 86 | 1107 |
| 741011 | N/A | N/A | 20559 | 20575 | AACTATGCTGCAATTTC | 74 | 1108 |
| 741012 | N/A | N/A | 20561 | 20577 | ACAACTATGCTGCAATT | 86 | 1109 |
| 741013 | N/A | N/A | 20562 | 20578 | CACAACTATGCTGCAAT | 88 | 314 |
| 741014 | N/A | N/A | 20565 | 20581 | TTCCACAACTATGCTGC | 90 | 1110 |
| 741015 | N/A | N/A | 20774 | 20790 | GACCACAATTGCAGACA | 86 | 1111 |
| 741016 | N/A | N/A | 20985 | 21001 | GTGTGAGCAAACATTCT | 94 | 1112 |
| 741017 | N/A N/A | N/A N/A | 27412 20987 | 27428 21003 | CAGTGTGAGCAAACATT | 90 | 1113 |
| 741018 | N/A N/A | N/A N/A | 27413 20988 | 27429 21004 | ACAGTGTGAGCAAACAT | 85 | 468 |
| 741019 | N/A N/A | N/A N/A | 27414 20989 | 27430 21005 | CACAGTGTGAGCAAACA | 91 | 1114 |
| 741020 | N/A | N/A | 20991 | 21007 | GGCACAGTGTGAGCAAA | 89 | 1115 |
| 741021 | N/A | N/A | 20999 | 21015 | AAGTTTCTGGCACAGTG | 89 | 1116 |
| 741022 | N/A | N/A | 21224 | 21240 | GTTCAGAATTATGTCAT | 95 | 1117 |
| 741023 | N/A | N/A | 21449 | 21465 | TCTTATGTGCACATGAG | 63 | 1118 |
| 741024 | N/A | N/A | 21674 | 21690 | CATAGTAGCATTACAGA | 83 | 1119 |
| 741025 | N/A | N/A | 21899 | 21915 | TCAGGCAGTGGCTTCAC | 66 | 1120 |
| 741026 | N/A | N/A | 22129 | 22145 | TAAAAAAGTTGTTCAT | 32 | 1121 |
| 741027 | N/A | N/A | 22360 | 22376 | CACTCAAGTGTTTAAAA | 87 | 1122 |
| 741028 | N/A | N/A | 22454 | 22470 | TGTGACCTGTGCTTGTT | 91 | 1123 |
| 741029 | N/A | N/A | 22456 | 22472 | CCTGTGACCTGTGCTTG | 87 | 1124 |
| 741030 | N/A | N/A | 22457 | 22473 | GCCTGTGACCTGTGCTT | 86 | 88 |

TABLE 17 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741031 | N/A | N/A | 22458 | 22474 | TGCCTGTGACCTGTGCT | 87 | 1125 |
| 741032 | N/A | N/A | 22460 | 22476 | GTTGCCTGTGACCTGTG | 82 | 1126 |
| 741033 | N/A | N/A | 22599 | 22615 | TATTAGACACTTAAGGG | 82 | 1127 |
| 741034 | N/A | N/A | 22831 | 22847 | TCAATCTTAAATTTTTC | 85 | 1128 |
| 741035 | N/A | N/A | 23056 | 23072 | GTACTTTCCCACCTAGA | 88 | 1129 |
| 741036 | N/A | N/A | 23281 | 23297 | TCTCAGAGACCACAGCT | 88 | 1130 |
| 741037 | N/A | N/A | 23285 | 23301 | TTGTTCTCAGAGACCAC | 92 | 1131 |
| 741038 | N/A | N/A | 23286 | 23302 | ATTGTTCTCAGAGACCA | 86 | 164 |
| 741039 | N/A | N/A | 23287 | 23303 | TATTGTTCTCAGAGACC | 94 | 1132 |
| 741040 | N/A | N/A | 23289 | 23305 | CATATTGTTCTCAGAGA | 89 | 1133 |
| 741041 | N/A | N/A | 23506 | 23522 | ACTATTAACCACTGATC | 84 | 1134 |
| 741042 | N/A | N/A | 23731 | 23747 | GTTGCAGTCCACAGAAT | 79 | 1135 |
| 741043 | N/A | N/A | 23956 | 23972 | TAAAGATAAGTATCTCA | 91 | 1136 |
| 741044 | N/A | N/A | 24181 | 24197 | AAAACAAACCTAAGTCA | 43 | 1137 |
| 741045 | N/A | N/A | 24406 | 24422 | AAAAGCTAACAGCCTAT | 73 | 1138 |
| 741046 | N/A | N/A | 24631 | 24647 | TTAAATTGATGAGATGT | 88 | 1139 |
| 741047 | N/A | N/A | 24856 | 24872 | GTATTCTTTGCATTAGT | 89 | 1140 |
| 741048 | N/A | N/A | 25081 | 25097 | TAAAAGTGTACATTATT | 77 | 1141 |
| 741049 | N/A | N/A | 25306 | 25322 | CTCAAGGCAAAGCTGTA | 88 | 1142 |
| 741050 | N/A | N/A | 25531 | 25547 | TGCCACTATAAGCAGTC | 94 | 1143 |
| 741051 | N/A | N/A | 25756 | 25772 | TTCAAGCCCATGCCCTC | 84 | 1144 |
| 741052 | N/A | N/A | 25801 | 25817 | ATCCAGTAGAGTGAGAG | 79 | 1145 |
| 741053 | N/A | N/A | 25803 | 25819 | TCATCCAGTAGAGTGAG | 89 | 1146 |
| 741054 | N/A | N/A | 25804 | 25820 | ATCATCCAGTAGAGTGA | 85 | 315 |
| 741055 | N/A | N/A | 25807 | 25823 | GACATCATCCAGTAGAG | 92 | 1147 |
| 741056 | N/A | N/A | 25923 | 25939 | TGAATACATTGTCTTAA | 81 | 1148 |
| 741057 | N/A | N/A | 25925 | 25941 | ATTGAATACATTGTCTT | 90 | 1149 |
| 741058 | N/A | N/A | 25926 | 25942 | AATTGAATACATTGTCT | 94 | 392 |
| 741059 | N/A | N/A | 25927 | 25943 | TAATTGAATACATTGTC | 84 | 1150 |
| 741060 | N/A | N/A | 25929 | 25945 | CATAATTGAATACATTG | 80 | 1151 |
| 741061 | N/A | N/A | 25981 | 25997 | TGAGTAGCTATGGTTTA | 91 | 1152 |
| 741062 | N/A | N/A | 26202 | 26218 | TCTTTGTGTTATACAAT | 58 | 1153 |
| 741063 | N/A | N/A | 26204 | 26220 | CCTCTTTGTGTTATACA | 83 | 1154 |
| 741064 | N/A | N/A | 26205 | 26221 | CCCTCTTTGTGTTATAC | 87 | 469 |
| 741065 | N/A | N/A | 26206 | 26222 | TCCCTCTTTGTGTTATA | 77 | 1155 |
| 741066 | N/A | N/A | 26208 | 26224 | TTTCCCTCTTTGTGTTA | 78 | 1156 |
| 741067 | N/A | N/A | 26431 | 26447 | TACATACAATATTAAGG | 78 | 1157 |

TABLE 17 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741068 | N/A | N/A | 26656 | 26672 | AAAAGAATGGATTCTGA | 75 | 1158 |
| 741069 | N/A | N/A | 26881 | 26897 | AAGGAAAAACTCTGCCC | 73 | 1159 |
| 741070 | N/A | N/A | 27106 | 27122 | TCACCCCAAGGCATTTG | 56 | 1160 |
| 741071 | N/A | N/A | 27331 | 27347 | ACACCCTGATTCCCAAG | 82 | 1161 |
| 741072 | N/A | N/A | 27410 | 27426 | GTGTGAGCAAACATTCA | 89 | 1162 |
| 741073 | N/A | N/A | 27416 | 27432 | GTCACAGTGTGAGCAAA | 91 | 1163 |
| 741074 | N/A | N/A | 27556 | 27572 | GGGAAGTATTAGTGGAA | 86 | 1164 |
| 741075 | N/A | N/A | 27782 | 27798 | GCTGAAAATATGAAACA | 76 | 1165 |
| 741076 | N/A | N/A | 28007 | 28023 | ACTTCTAGCACTATTTT | 71 | 1166 |
| 741077 | N/A | N/A | 28232 | 28248 | TTGTGCATTTATTCCAC | 93 | 1167 |
| 741078 | N/A | N/A | 28457 | 28473 | GACTGTAATCTAGGACC | 90 | 1168 |
| 741079 | N/A | N/A | 28682 | 28698 | TGACTTTTGAATCAGTC | 59 | 1169 |
| 741080 | N/A | N/A | 29010 | 29026 | GAGCGATTCTCCTGGTT | 76 | 1170 |
| 741081 | N/A | N/A | 29235 | 29251 | CACAGTCCATAATATTG | 79 | 1171 |
| 741082 | N/A | N/A | 29460 | 29476 | TTTTTGTTAATAGTTCT | 80 | 1172 |
| 741083 | N/A | N/A | 29685 | 29701 | GCTTTCTCAGAGCCCAA | 89 | 1173 |
| 741084 | N/A | N/A | 29912 | 29928 | ATCTCTCTACCATGTGA | 79 | 1174 |
| 741085 | N/A | N/A | 30137 | 30153 | GTGGATAAAGTACATTA | 77 | 1175 |
| 741086 | N/A | N/A | 30362 | 30378 | AAATGGTATTCAGAGAT | 76 | 1176 |

TABLE 18

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 91 | 33 |
| 740432 | 270 | 286 | 4721 | 4737 | AGTCCTTTCATGAATAC | 94 | 591 |
| 741087 | N/A | N/A | 30587 | 30603 | TTTTCTCCTAAAGCCTT | 85 | 1177 |
| 741088 | N/A | N/A | 31037 | 31053 | CAGATTTCCAGCACACT | 81 | 1178 |
| 741089 | N/A | N/A | 31262 | 31278 | CCTTCTTAGTGGTAAGA | 64 | 1179 |
| 741090 | N/A | N/A | 31487 | 31503 | AATTACAGTGTAGGTAA | 52 | 1180 |
| 741091 | N/A | N/A | 31712 | 31728 | ATAAGAGGTCACTGGAT | 91 | 1181 |
| 741092 | N/A | N/A | 31937 | 31953 | AAGGAAACAGTCTACAT | 85 | 1182 |
| 741093 | N/A | N/A | 32162 | 32178 | CTATCATGATAAGTATA | 84 | 1183 |
| 741094 | N/A | N/A | 32387 | 32403 | TGTGGTTCTGCCCATCT | 88 | 1184 |
| 741095 | N/A | N/A | 32624 | 32640 | GCCTAAACATTTTACTT | 34 | 1185 |

TABLE 18 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741096 | N/A | N/A | 32858 | 32874 | GAAGTTTCTGAAGAAAT | 89 | 1186 |
| 741097 | N/A | N/A | 33083 | 33099 | TTTTCAGTAGATTTGAC | 86 | 1187 |
| 741098 | N/A | N/A | 33308 | 33324 | GCTATGACCCTCAAGCC | 68 | 1188 |
| 741099 | N/A | N/A | 33533 | 33549 | AATAGAGCAAAATTTCG | 87 | 1189 |
| 741100 | N/A | N/A | 33762 | 33778 | ATAATCAAACAAAGGG | 73 | 1190 |
| 741101 | N/A | N/A | 33987 | 34003 | AAAGTTCAATGCTGTGT | 94 | 1191 |
| 741102 | N/A | N/A | 34212 | 34228 | GAAATGGGCATGTAAAC | 72 | 1192 |
| 741103 | N/A | N/A | 34443 | 34459 | CAAAATACAATGTTCAA | 40 | 1193 |
| 741104 | N/A | N/A | 34668 | 34684 | ATTCTTCTATCCTAGAA | 12 | 1194 |
| 741105 | N/A | N/A | 34893 | 34909 | ATTATCATGGTTGCCCA | 91 | 1195 |
| 741106 | N/A | N/A | 35118 | 35134 | ATGAGATCTTTTTGCAT | 87 | 1196 |
| 741107 | N/A | N/A | 35343 | 35359 | AAGCAAGTTGTCCATGG | 90 | 1197 |
| 741108 | N/A | N/A | 35568 | 35584 | TGTTGGAGTTTACAATT | 76 | 1198 |
| 741109 | N/A | N/A | 35793 | 35809 | CTCACTAGCCCTGTGAC | 14 | 1199 |
| 741110 | N/A | N/A | 36018 | 36034 | TCTCTTTCATGGGTATT | 92 | 1200 |
| 741111 | N/A | N/A | 36252 | 36268 | GTCATTTTAATAAGTGT | 92 | 1201 |
| 741112 | N/A | N/A | 36484 | 36500 | CAATTAAATAAACCTCT | 65 | 1202 |
| 741113 | N/A | N/A | 36790 | 36806 | TATGGTGATATGGTTAG | 91 | 1203 |
| 741114 | N/A | N/A | 37018 | 37034 | CCATGTGTTTTGTGGC | 84 | 1204 |
| 741115 | N/A | N/A | 37243 | 37259 | CAAAGGTATAAGGTCAT | 94 | 1205 |
| 741116 | N/A | N/A | 37468 | 37484 | AGCTTGTATTTTTGAAA | 86 | 1206 |
| 741117 | N/A | N/A | 37788 | 37804 | CGCATCTGTCTTTCTTT | 78 | 1207 |
| 741118 | N/A | N/A | 38013 | 38029 | TAGGACAGGTGAAATAA | 72 | 1208 |
| 741119 | N/A | N/A | 38238 | 38254 | AGTTATTAGAATAACAC | 0 | 1209 |
| 741120 | N/A | N/A | 38464 | 38480 | AATAAAATGTCTTAATC | 25 | 1210 |
| 741121 | N/A | N/A | 38691 | 38707 | ACTCAAAAAAGAAGAAT | 44 | 1211 |
| 741122 | N/A | N/A | 38916 | 38932 | GTTTTCTCTGTATTGGC | 93 | 1212 |
| 741123 | N/A | N/A | 39141 | 39157 | TGGCCTAGTGGTTATAA | 19 | 1213 |
| 741124 | N/A | N/A | 39366 | 39382 | CACAAAGAGGAAACAGG | 80 | 1214 |
| 741125 | N/A | N/A | 39591 | 39607 | ACATTTTTTAACTGGAT | 92 | 1215 |
| 741126 | N/A | N/A | 39816 | 39832 | AGGCTAAATTTTAATAA | 6 | 1216 |
| 741127 | N/A | N/A | 40041 | 40057 | TAGCCTTTCATAGTACG | 90 | 1217 |
| 741128 | N/A | N/A | 40266 | 40282 | AAGAGGAAAAGCTTGGA | 43 | 1218 |
| 741129 | N/A | N/A | 40491 | 40507 | AAAAATTCTGGTGCCAA | 94 | 1219 |
| 741130 | N/A | N/A | 40716 | 40732 | AAGCTAAACTACCGCTG | 58 | 1220 |
| 741131 | N/A | N/A | 40941 | 40957 | GAATTTCCTGGATGCTC | 92 | 1221 |
| 741132 | N/A | N/A | 41130 | 41146 | AGATTCCAGCAGAGATT | 74 | 1222 |

TABLE 18 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741133 | N/A | N/A | 41132 | 41148 | ACAGATTCCAGCAGAGA | 89 | 1223 |
| 741134 | N/A | N/A | 41133 | 41149 | AACAGATTCCAGCAGAG | 87 | 90 |
| 741135 | N/A | N/A | 41134 | 41150 | GAACAGATTCCAGCAGA | 85 | 1224 |
| 741136 | N/A | N/A | 41136 | 41152 | GTGAACAGATTCCAGCA | 86 | 1225 |
| 741137 | N/A | N/A | 41166 | 41182 | ATCTGTAAGAAGTTTAG | 52 | 1226 |
| 741138 | N/A | N/A | 41391 | 41407 | TGAGAAATTTTATGGGT | 86 | 1227 |
| 741139 | N/A | N/A | 41620 | 41636 | TCATTCAAAACCATCCT | 78 | 1228 |
| 741140 | N/A | N/A | 41845 | 41861 | GATCACACTGCTTATAG | 84 | 1229 |
| 741141 | N/A | N/A | 42070 | 42086 | CAAGTTGATGGCATATA | 89 | 1230 |
| 741142 | N/A | N/A | 42295 | 42311 | GTGTACCAACCTCAAGT | 71 | 1231 |
| 741143 | N/A | N/A | 42532 | 42548 | TAAGTAAATACCTAGGG | 83 | 1232 |
| 741144 | N/A | N/A | 42757 | 42773 | GATTTGTGCCTGGCATC | 91 | 1233 |
| 741145 | N/A | N/A | 42835 | 42851 | TGCCTCTACCTCCAGCA | 89 | 1234 |
| 741146 | N/A | N/A | 42837 | 42853 | GATGCCTCTACCTCCAG | 87 | 1235 |
| 741147 | N/A | N/A | 42838 | 42854 | TGATGCCTCTACCTCCA | 85 | 166 |
| 741148 | N/A | N/A | 42839 | 42855 | CTGATGCCTCTACCTCC | 87 | 1236 |
| 741149 | N/A | N/A | 42982 | 42998 | TATCACAACTACATTGT | 40 | 1237 |
| 741150 | N/A | N/A | 43208 | 43224 | GGCCTCCTGCTGCAGCA | 31 | 1238 |
| 741151 | N/A | N/A | 43440 | 43456 | GCACTCATTTTAAATGT | 72 | 1239 |
| 741152 | N/A | N/A | 43665 | 43681 | TGGTAACTTAGGACAAG | 93 | 1240 |
| 741153 | N/A | N/A | 43818 | 43834 | TTCTCTGGACCTCTTAA | 67 | 1241 |
| 741154 | N/A | N/A | 43820 | 43836 | ACTTCTCTGGACCTCTT | 85 | 1242 |
| 741155 | N/A | N/A | 43821 | 43837 | TACTTCTCTGGACCTCT | 92 | 242 |
| 741156 | N/A | N/A | 43822 | 43838 | TTACTTCTCTGGACCTC | 90 | 1243 |
| 741157 | N/A | N/A | 43890 | 43906 | TCAATACAACTTAATTC | 48 | 1244 |
| 741158 | N/A | N/A | 44376 | 44392 | TTGGGCTGGAAGCAGTG | 43 | 1245 |
| 741159 | N/A | N/A | 44601 | 44617 | AAGATATGCAGAGGGTT | 92 | 1246 |
| 741160 | N/A | N/A | 44828 | 44844 | TGGTCTAACTGTGTTGC | 85 | 1247 |
| 741161 | N/A | N/A | 45053 | 45069 | GTTTATGGACTTTTAA | 87 | 1248 |
| 741162 | N/A | N/A | 45278 | 45294 | TTTTGTACTTTATGGAA | 89 | 1249 |
| 741163 | N/A | N/A | 45503 | 45519 | ACTTCTCCTTCAATTAA | 72 | 1250 |

TABLE 19

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 90 | 33 |
| 740432 | 270 | 286 | 4721 | 4737 | AGTCCTTTCATGAATAC | 90 | 591 |
| 741241 | N/A | N/A | 56397 | 56413 | AAAATTTTTGCACACTT | 94 | 1251 |
| 741242 | N/A | N/A | 56622 | 56638 | GCCAAATCAATGGATGA | 90 | 1252 |
| 741243 | N/A | N/A | 56847 | 56863 | AGTGACCAAGAGAATGA | 53 | 1253 |
| 741244 | N/A | N/A | 57072 | 57088 | TTTTAAAACACTGGCCT | 41 | 1254 |
| 741245 | N/A | N/A | 57297 | 57313 | TAGGATTAAACAGTCCA | 48 | 1255 |
| 741246 | N/A | N/A | 57522 | 57538 | TTATCTGTTGCTATGTG | 91 | 1256 |
| 741247 | N/A | N/A | 57747 | 57763 | AAGAAGGAGAATAGCAG | 86 | 1257 |
| 741248 | N/A | N/A | 57981 | 57997 | CGGGCAAACATGTTTTG | 47 | 1258 |
| 741249 | N/A | N/A | 58206 | 58222 | ATGACCTACATGCTAAA | 73 | 1259 |
| 741250 | N/A | N/A | 58431 | 58447 | AGAAGCAAAATGTCAGT | 88 | 1260 |
| 741251 | N/A | N/A | 58656 | 58672 | CCTAACAGCTTTACTTT | 50 | 1261 |
| 741252 | N/A | N/A | 58881 | 58897 | CTTTCACACATCTCTAA | 64 | 1262 |
| 741253 | N/A | N/A | 58991 | 59007 | TTTCATTAATCTGTGAA | 34 | 1263 |
| 741254 | N/A | N/A | 58992 | 59008 | ATTTCATTAATCTGTGA | 86 | 169 |
| 741255 | N/A | N/A | 58993 | 59009 | TATTTCATTAATCTGTG | 93 | 1264 |
| 741256 | N/A | N/A | 58995 | 59011 | TATATTTCATTAATCTG | 87 | 1265 |
| 741257 | N/A | N/A | 59106 | 59122 | CCTTACACAAAATATAA | 38 | 1266 |
| 741258 | N/A | N/A | 59354 | 59370 | ACACCAATATATTATTT | 67 | 1267 |
| 741259 | N/A | N/A | 59594 | 59610 | TAAAGGATGCAAAGGCA | 55 | 1268 |
| 741260 | N/A | N/A | 59948 | 59964 | TTCCAGCGATCCCACTC | 80 | 1269 |
| 741261 | N/A | N/A | 60173 | 60189 | CTCAACATCTTTAATGA | 35 | 1270 |
| 741262 | N/A | N/A | 60421 | 60437 | GGGACCTAAAACTATAA | 25 | 1271 |
| 741263 | N/A | N/A | 60758 | 60774 | AGCAGAATAGAAAATCC | 49 | 1272 |
| 741264 | N/A | N/A | 60983 | 60999 | TTCAATGCGACTCCCAT | 81 | 1273 |
| 741265 | N/A | N/A | 61216 | 61232 | CAACAAAACTGAGAATC | 24 | 1274 |
| 741266 | N/A | N/A | 61474 | 61490 | AATGCCTGCTTTCACCA | 76 | 1275 |
| 741267 | N/A | N/A | 61699 | 61715 | TATAAGCAGGAGTAAAA | 27 | 1276 |
| 741268 | N/A | N/A | 61969 | 61985 | GTTCCAAAAGATAGAGA | 55 | 1277 |
| 741269 | N/A | N/A | 62200 | 62216 | CGTACACAAACTAGAAA | 33 | 1278 |
| 741270 | N/A | N/A | 62492 | 62508 | TACTGTTGCATTCCAGC | 70 | 1279 |
| 741271 | N/A | N/A | 62729 | 62745 | TCTTAGTGTGGTGGCTC | 78 | 1280 |
| 741272 | N/A | N/A | 62955 | 62971 | TCAACAATAATAATGAC | 60 | 1281 |
| 741273 | N/A | N/A | 63197 | 63213 | CCTTTTCATCAACACAT | 71 | 1282 |
| 741274 | N/A | N/A | 63422 | 63438 | TATGCATCTAACACTTG | 52 | 1283 |
| 741275 | N/A | N/A | 63666 | 63682 | CCATCAACCAAGTATCT | 26 | 1284 |

TABLE 19 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741276 | N/A | N/A | 63891 | 63907 | CTTGAAACAGTAACTTG | 47 | 1285 |
| 741277 | N/A | N/A | 64116 | 64132 | AACATAGCAGATTAATA | 37 | 1286 |
| 741278 | N/A | N/A | 64349 | 64365 | TCATGTTATATAGTGGG | 97 | 1287 |
| 741279 | N/A | N/A | 64574 | 64590 | TGTAACCTAATGTAAAT | 37 | 1288 |
| 741280 | N/A | N/A | 64799 | 64815 | ACAAGTATCTGTACTCA | 94 | 1289 |
| 741281 | N/A | N/A | 65024 | 65040 | GTCTCTGTTAATGTTGG | 75 | 1290 |
| 741282 | N/A | N/A | 65249 | 65265 | GAACCAGCCTGACTTAA | 74 | 1291 |
| 741283 | N/A | N/A | 65474 | 65490 | TTGTATGGGTTACATAA | 61 | 1292 |
| 741284 | N/A | N/A | 65801 | 65817 | CAATTAAATGCAATTCC | 53 | 1293 |
| 741285 | N/A | N/A | 66026 | 66042 | TGACAGAAGTGTGCATA | 59 | 1294 |
| 741286 | N/A | N/A | 66251 | 66267 | CAACACATCCACATTGC | 75 | 1295 |
| 741287 | N/A | N/A | 66476 | 66492 | TTCACACCTCTCTCCCT | 51 | 1296 |
| 741288 | N/A | N/A | 66701 | 66717 | TGCTGGTCTAAGATGCA | 77 | 1297 |
| 741289 | N/A | N/A | 66926 | 66942 | ATGTGTTTTGAGGAAAA | 77 | 1298 |
| 741290 | N/A | N/A | 67151 | 67167 | CAGAAGTAAATGTGGAC | 85 | 1299 |
| 741291 | N/A | N/A | 67376 | 67392 | TGATTCTTTGGATTCAT | 79 | 1300 |
| 741292 | N/A | N/A | 67876 | 67892 | CATTCTTGTTTTTATTC | 86 | 1301 |
| 741293 | N/A | N/A | 68101 | 68117 | AATAGTGTCCCAGTGTA | 78 | 1302 |
| 741294 | N/A | N/A | 68326 | 68342 | TGAAAGCTGTTCAGTTA | 74 | 1303 |
| 741295 | N/A | N/A | 68551 | 68567 | CCCACATATACTACTTG | 86 | 1304 |
| 741296 | N/A | N/A | 68776 | 68792 | AGAATTTCAGGAAGTTA | 87 | 1305 |
| 741297 | N/A | N/A | 68798 | 68814 | CAAAGTAAGAGGAGATT | 62 | 1306 |
| 741298 | N/A | N/A | 68800 | 68816 | GCCAAAGTAAGAGGAGA | 90 | 1307 |
| 741299 | N/A | N/A | 68801 | 68817 | TGCCAAAGTAAGAGGAG | 61 | 397 |
| 741300 | N/A | N/A | 68804 | 68820 | CAGTGCCAAAGTAAGAG | 64 | 1308 |
| 741301 | N/A | N/A | 69001 | 69017 | TGAATCCATTTGTCCAG | 91 | 1309 |
| 741302 | N/A | N/A | 69227 | 69243 | CTCTAAAATACAAATGT | 72 | 1310 |
| 741303 | N/A | N/A | 69452 | 69468 | GAACAAAGGAATAAGTA | 59 | 1311 |
| 741304 | N/A | N/A | 69677 | 69693 | CTAGATGTAGATATCAT | 61 | 1312 |
| 741305 | N/A | N/A | 69902 | 69918 | AAGGGAATAAATTGTAG | 52 | 1313 |
| 741306 | N/A | N/A | 70127 | 70143 | CAACAGACCCTTTCAAT | 60 | 1314 |
| 741307 | N/A | N/A | 70352 | 70368 | GTCTTCCCACTGCCTAC | 62 | 1315 |
| 741308 | N/A | N/A | 70577 | 70593 | TTTAGATATACCTCCAA | 94 | 1316 |
| 741309 | N/A | N/A | 70880 | 70896 | GCTTCAGTTTCTTGAGT | 79 | 1317 |
| 741310 | N/A | N/A | 71105 | 71121 | CTGGTCTTTCTCACAAT | N.D. | 1318 |
| 741311 | N/A | N/A | 71375 | 71391 | ATCATTCTTAACAGAAA | 70 | 1319 |

TABLE 19 -continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741312 | N/A | N/A | 71600 | 71616 | GCTCTTGCTGTGCAGCC | 74 | 1320 |
| 741313 | N/A | N/A | 71844 | 71860 | ATTTAAAGCAGCAGTCC | 50 | 1321 |
| 741314 | N/A | N/A | 72076 | 72092 | AGGTAATTCTAATTTTA | 68 | 1322 |
| 741315 | N/A | N/A | 72301 | 72317 | GGCAAATGACAGGGTCT | 93 | 1323 |
| 741316 | N/A | N/A | 72632 | 72648 | TCTCAACTGCCTGAGTA | 22 | 1324 |
| 741317 | N/A | N/A | 72857 | 72873 | CATGTCAGCTTTTTAGT | 69 | 1325 |

TABLE 20

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 95 | 33 |
| 740432 | 270 | 286 | 4721 | 4737 | AGTCCTTTCATGAATAC | 94 | 591 |
| 741318 | N/A | N/A | 73090 | 73106 | ATACTCAGATATTTAAA | 64 | 1326 |
| 741319 | N/A | N/A | 73188 | 73204 | ACTTTCTGTGTGGTATG | 91 | 1327 |
| 741320 | N/A | N/A | 73190 | 73206 | AGACTTTCTGTGTGGTA | 95 | 1328 |
| 741321 | N/A | N/A | 73191 | 73207 | CAGACTTTCTGTGTGGT | 93 | 170 |
| 741322 | N/A | N/A | 73192 | 73208 | ACAGACTTTCTGTGTGG | 86 | 1329 |
| 741323 | N/A | N/A | 73194 | 73210 | AGACAGACTTTCTGTGT | 46 | 1330 |
| 741324 | N/A | N/A | 73315 | 73331 | GTTGAGAATTTTTCATT | 66 | 1331 |
| 741325 | N/A | N/A | 73540 | 73556 | AGTTATGGAGCATCTTT | 89 | 1332 |
| 741326 | N/A | N/A | 73765 | 73781 | GACTGAGTTTTTTATTC | 74 | 1333 |
| 741327 | N/A | N/A | 73990 | 74006 | TCCTGAATTAAAAATTT | 13 | 1334 |
| 741328 | N/A | N/A | 74215 | 74231 | GCTAAGCACAAACAATT | 62 | 1335 |
| 741329 | N/A | N/A | 74292 | 74308 | GAACTCTGTAGTCAGAA | 92 | 1336 |
| 741330 | N/A | N/A | 74294 | 74310 | TAGAACTCTGTAGTCAG | 93 | 1337 |
| 741331 | N/A | N/A | 74295 | 74311 | ATAGAACTCTGTAGTCA | 95 | 398 |
| 741332 | N/A | N/A | 74296 | 74312 | AATAGAACTCTGTAGTC | 92 | 1338 |
| 741333 | N/A | N/A | 74298 | 74314 | TGAATAGAACTCTGTAG | 85 | 1339 |
| 741334 | N/A | N/A | 74440 | 74456 | ACACAGAGCACTTCTTA | 70 | 1340 |
| 741335 | N/A | N/A | 74665 | 74681 | GGAGTTACAGAGTTGCC | 91 | 1341 |
| 741336 | N/A | N/A | 74890 | 74906 | TATCAGTCTATTAAGAA | 82 | 1342 |
| 741337 | N/A | N/A | 75115 | 75131 | AAGTTTCTCAGAGCCTG | 82 | 1343 |
| 741338 | N/A | N/A | 75340 | 75356 | AATACAGAAGTCTATTC | 68 | 1344 |
| 741339 | N/A | N/A | 75573 | 75589 | CATTGAATAAAAATTTG | 18 | 1345 |
| 741340 | N/A | N/A | 75945 | 75961 | CAGGTATAAAATTTTTT | 45 | 1346 |

TABLE 20-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741341 | N/A | N/A | 76170 | 76186 | GGTGTTAATCACTTGAA | 86 | 1347 |
| 741342 | N/A | N/A | 76398 | 76414 | TCTTGAAGCTAGTTGGG | 91 | 1348 |
| 741343 | N/A | N/A | 76623 | 76639 | AGGGCAACTAACCAACA | 75 | 1349 |
| 741344 | N/A | N/A | 76848 | 76864 | GTGGATACTTAGTATCA | 69 | 1350 |
| 741345 | N/A | N/A | 77073 | 77089 | CTCTCTCAGTTGTAGGT | 67 | 1351 |
| 741346 | N/A | N/A | 77298 | 77314 | AAAGTATGCTGTGTTCT | 92 | 1352 |
| 741347 | N/A | N/A | 77523 | 77539 | GTACCCGGCACTTTTCC | 53 | 1353 |
| 741348 | N/A | N/A | 77663 | 77679 | TCTAGAAAAGCTCTCTT | 57 | 1354 |
| 741349 | N/A | N/A | 77665 | 77681 | ACTCTAGAAAAGCTCTC | 81 | 1355 |
| 741350 | N/A | N/A | 77666 | 77682 | GACTCTAGAAAAGCTCT | 91 | 247 |
| 741351 | N/A | N/A | 77667 | 77683 | AGACTCTAGAAAAGCTC | 84 | 1356 |
| 741352 | N/A | N/A | 77748 | 77764 | TGGCACCCAGGAGTAAG | 65 | 1357 |
| 741353 | N/A | N/A | 77973 | 77989 | CATACACAAAATCCCCT | 83 | 1358 |
| 741354 | N/A | N/A | 78198 | 78214 | CACATGAAGCCAGGGAC | 77 | 1359 |
| 741355 | N/A | N/A | 78423 | 78439 | GCAGGCCCTAAACTGTG | 39 | 1360 |
| 741356 | N/A | N/A | 78648 | 78664 | AAATTTATCTATCATGC | 93 | 1361 |
| 741357 | N/A | N/A | 78873 | 78889 | GCTAAACACTTTATCAA | 75 | 1362 |
| 741358 | N/A | N/A | 79098 | 79114 | ACTTCATTCTTTCTGTT | 87 | 1363 |
| 741359 | N/A | N/A | 79323 | 79339 | CAATTAAAAGATTACTT | 0 | 1364 |
| 741360 | N/A | N/A | 79548 | 79564 | ACATTGTACAGTTAATT | 77 | 1365 |
| 741361 | N/A | N/A | 79773 | 79789 | TACAAACCTTACTATGC | 51 | 1366 |
| 741362 | N/A | N/A | 79998 | 80014 | AACAGACTTAAACAAAC | 88 | 1367 |
| 741363 | N/A | N/A | 80223 | 80239 | CTCAGACATCATGTTTT | 91 | 1368 |
| 741364 | N/A | N/A | 80448 | 80464 | AGGCACTCACAAACATT | 86 | 1369 |
| 741365 | N/A | N/A | 80673 | 80689 | TCTCGCATCCTAAATGT | 50 | 1370 |
| 741366 | N/A | N/A | 80898 | 80914 | TTCATATTTTATGTTAC | 89 | 1371 |
| 741367 | N/A | N/A | 80991 | 81007 | TGAAATTTCCAGCTAA | 93 | 1372 |
| 741368 | N/A | N/A | 80993 | 81009 | CTTGAAATTTTCCAGCT | 97 | 1373 |
| 741369 | N/A | N/A | 80995 | 81011 | ATCTTGAAATTTTCCAG | 86 | 1374 |
| 741370 | N/A | N/A | 81123 | 81139 | CTATAATTACATTCCTA | 73 | 1375 |
| 741371 | N/A | N/A | 81348 | 81364 | GCATGAACCTAGATATG | 58 | 1376 |
| 741372 | N/A | N/A | 81472 | 81488 | GCTGTTTGAAGTGACAA | 70 | 1377 |
| 741373 | N/A | N/A | 81474 | 81490 | GAGCTGTTTGAAGTGAC | 90 | 1378 |
| 741374 | N/A | N/A | 81475 | 81491 | AGAGCTGTTTGAAGTGA | 82 | 249 |
| 741375 | N/A | N/A | 81476 | 81492 | GAGAGCTGTTTGAAGTG | 76 | 1379 |
| 741376 | N/A | N/A | 81478 | 81494 | TGGAGAGCTGTTTGAAG | 69 | 1380 |

TABLE 20-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741377 | N/A | N/A | 81575 | 81591 | CTGCCACTATTCACAAT | 71 | 1381 |
| 741378 | N/A | N/A | 81800 | 81816 | TTATTGCATTAATGGAA | 94 | 1382 |
| 741379 | N/A | N/A | 82107 | 82123 | ATGGTGTTAGCTAGGAT | 91 | 1383 |
| 741380 | N/A | N/A | 82332 | 82348 | GTCTTTTTACATTATAA | 93 | 1384 |
| 741381 | N/A | N/A | 82557 | 82573 | ATAACCACTATTCAATG | 63 | 1385 |
| 741382 | N/A | N/A | 82783 | 82799 | AAAAATCACATTTGGCA | 95 | 1386 |
| 741383 | N/A | N/A | 83008 | 83024 | TTCTTTCACCTTATGAG | 72 | 1387 |
| 741384 | N/A | N/A | 83233 | 83249 | ATATATGTGTCAGTTCT | 90 | 1388 |
| 741385 | N/A | N/A | 83458 | 83474 | GTGTCACTTTTTAAGGT | 14 | 1389 |
| 741386 | N/A | N/A | 83528 | 83544 | AGAACAATGTCATCTTT | 94 | 1390 |
| 741387 | N/A | N/A | 83530 | 83546 | AAAGAACAATGTCATCT | 88 | 1391 |
| 741388 | N/A | N/A | 83531 | 83547 | GAAAGAACAATGTCATC | 89 | 98 |
| 741389 | N/A | N/A | 83532 | 83548 | GGAAAGAACAATGTCAT | 82 | 1392 |
| 741390 | N/A | N/A | 83534 | 83550 | CAGGAAAGAACAATGTC | 88 | 1393 |
| 741391 | N/A | N/A | 83683 | 83699 | CACAGGTATACACACTT | 90 | 1394 |
| 741392 | N/A | N/A | 83908 | 83924 | GTACAAAATCTGCATAT | 81 | 1395 |
| 741393 | N/A | N/A | 84133 | 84149 | ATAGGTATTTTATGCAT | 88 | 1396 |
| 741394 | N/A | N/A | 84616 | 84632 | CAAATTATGCATTTGTT | 66 | 1397 |

TABLE 21

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 95 | 33 |
| 740432 | 270 | 286 | 4721 | 4737 | AGTCCTTTCATGAATAC | 93 | 591 |
| 741395 | N/A | N/A | 84845 | 84861 | CTACAAAATTGCTAAAA | 9 | 1398 |
| 741396 | N/A | N/A | 85070 | 85086 | ACAATGTTACTTTGTCC | 90 | 1399 |
| 741397 | N/A | N/A | 85295 | 85311 | TACAAAATACCCCCCC | 12 | 1400 |
| 741398 | N/A | N/A | 85520 | 85536 | ATTTGTAGACCTATGTT | 62 | 1401 |
| 741399 | N/A | N/A | 85745 | 85761 | AAGCATCTCCTGTGGTG | 78 | 1402 |
| 741400 | N/A | N/A | 85970 | 85986 | CAACATGTTTTATCATG | 68 | 1403 |
| 741401 | N/A | N/A | 86195 | 86211 | AATATGACCACAATTTT | 73 | 1404 |
| 741402 | N/A | N/A | 86420 | 86436 | TGGCAATATGAATGTGC | 86 | 1405 |
| 741403 | N/A | N/A | 86645 | 86661 | GATAAGGGCACATTGTC | 64 | 1406 |
| 741404 | N/A | N/A | 86871 | 86887 | GTGATGGAGGGAAATCG | 53 | 1407 |
| 741405 | N/A | N/A | 87096 | 87112 | TGTGGTAATTGGAACAA | 34 | 1408 |

TABLE 21-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741406 | N/A | N/A | 87321 | 87337 | ACTGAACCCAAATGGCT | 68 | 1409 |
| 741407 | N/A | N/A | 87546 | 87562 | TCACATTCATCATATTC | 81 | 1410 |
| 741408 | N/A | N/A | 87772 | 87788 | CATTGCTGTTGTTGTTC | 92 | 1411 |
| 741409 | N/A | N/A | 87945 | 87961 | TAAGTTGTGACCATGCA | 87 | 1412 |
| 741410 | N/A | N/A | 87946 | 87962 | GTAAGTTGTGACCATGC | 95 | 402 |
| 741411 | N/A | N/A | 87947 | 87963 | AGTAAGTTGTGACCATG | 96 | 1413 |
| 741412 | N/A | N/A | 87949 | 87965 | TTAGTAAGTTGTGACCA | 76 | 1414 |
| 741413 | N/A | N/A | 87997 | 88013 | AATAAAAATGTGCATGC | 47 | 1415 |
| 741414 | N/A | N/A | 88222 | 88238 | AACAAAATACAGTCAGA | 91 | 1416 |
| 741415 | N/A | N/A | 88447 | 88463 | TTTGTACTGTGTGCTGT | 89 | 1417 |
| 741416 | N/A<br>N/A | N/A<br>N/A | 89657<br>88652 | 89673<br>88668 | TGACATACAAACCCAAA | 78 | 1418 |
| 741417 | N/A<br>N/A | N/A<br>N/A | 89658<br>88653 | 89674<br>88669 | TTGACATACAAACCCAA | 87 | 326 |
| 741418 | N/A<br>N/A | N/A<br>N/A | 89659<br>88654 | 89675<br>88670 | CTTGACATACAAACCCA | 82 | 1419 |
| 741419 | N/A<br>N/A | N/A<br>N/A | 89681<br>88676 | 89697<br>88692 | GTCCCCAATCCCCACCC | 19 | 100 |
| 741420 | N/A | N/A | 88705 | 88721 | GAAGTTAACTCCCTAGA | 83 | 1420 |
| 741421 | N/A | N/A | 88707 | 88723 | ATGAAGTTAACTCCCTA | 92 | 1421 |
| 741422 | N/A<br>N/A | N/A<br>N/A | 89713<br>88708 | 89729<br>88724 | GATGAAGTTAACTCCCT | 92 | 176 |
| 741423 | N/A<br>N/A | N/A<br>N/A | 89714<br>88709 | 89730<br>88725 | AGATGAAGTTAACTCCC | 86 | 1422 |
| 741424 | N/A<br>N/A | N/A<br>N/A | 89716<br>88711 | 89732<br>88727 | AGAGATGAAGTTAACTC | 78 | 252 |
| 741425 | N/A | N/A | 88754 | 88770 | TTTTCAAGAGCTTTTCG | 67 | 1423 |
| 741426 | N/A<br>N/A | N/A<br>N/A | 89761<br>88756 | 89777<br>88772 | CCTTTTCAAGAGCTTTT | 90 | 1424 |
| 741427 | N/A<br>N/A | N/A<br>N/A | 89763<br>88758 | 89779<br>88774 | TCCCTTTTCAAGAGCTT | 96 | 1425 |
| 741428 | N/A<br>N/A | N/A<br>N/A | 89765<br>88760 | 89781<br>88776 | TTTCCCTTTTCAAGAGC | 93 | 1426 |
| 741429 | N/A<br>N/A | N/A<br>N/A | 89767<br>88762 | 89783<br>88778 | TATTTCCCTTTTCAAGA | 32 | 1427 |
| 741430 | N/A | N/A | 88901 | 88917 | ACAAGTAGGTAGGTCAA | 83 | 1428 |
| 741431 | N/A | N/A | 89126 | 89142 | TGAGCCATATTCAATAT | 66 | 1429 |
| 741432 | N/A | N/A | 89351 | 89367 | AAATTGCTAGGTTCAAC | 77 | 1430 |
| 741433 | N/A | N/A | 89579 | 89595 | ATCAAATATTTACTAGA | 49 | 1431 |
| 741434 | N/A<br>N/A | N/A<br>N/A | 89655<br>88650 | 89671<br>88666 | ACATACAAACCCAAAGA | 43 | 1432 |
| 741435 | N/A<br>N/A | N/A<br>N/A | 89661<br>88656 | 89677<br>88672 | CACTTGACATACAAACC | 58 | 1433 |

TABLE 21-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741436 | N/A | N/A | 89710 | 89726 | GAAGTTAACTCCCTTGA | 69 | 1434 |
| 741437 | N/A | N/A | 89712 | 89728 | ATGAAGTTAACTCCCTT | 92 | 1435 |
| 741438 | N/A | N/A | 89759 | 89775 | TTTTCAAGAGCTTTTCT | 66 | 1436 |
| 741439 | N/A | N/A | 89804 | 89820 | TCTACAGGTTATATGTG | 46 | 1437 |
| 741440 | N/A | N/A | 90029 | 90045 | TCCCAAAGTGCAAGACT | 53 | 1438 |
| 741441 | N/A | N/A | 90321 | 90337 | CTCTATTGTTATATTTT | 86 | 1439 |
| 741442 | N/A | N/A | 90546 | 90562 | ATCTAACTCCTAGCACA | 37 | 1440 |
| 741443 | N/A | N/A | 90771 | 90787 | ATACTTTCTCTGCATAA | 65 | 1441 |
| 741444 | N/A | N/A | 91050 | 91066 | TAGCTATAGTGCAATGG | 52 | 1442 |
| 741445 | N/A | N/A | 91277 | 91293 | CTGGAATTCCAGAAAAA | 63 | 1443 |
| 741446 | N/A | N/A | 91502 | 91518 | CTTTCAAATCTCATTAC | 68 | 1444 |
| 741447 | N/A | N/A | 91727 | 91743 | TCTTCTTTTGCAGAGAT | 65 | 1445 |
| 741448 | N/A | N/A | 91952 | 91968 | TAGAGCATTAAGAACAT | 68 | 1446 |
| 741449 | N/A | N/A | 92177 | 92193 | GTTACTAAAAAAAACCA | 41 | 1447 |
| 741450 | N/A | N/A | 92402 | 92418 | TCCCATTGGACTGAGTT | 53 | 1448 |
| 741451 | N/A | N/A | 92627 | 92643 | TATCCATTTTCCAGTTA | 83 | 1449 |
| 741452 | N/A | N/A | 92852 | 92868 | CCAGGGTGCTATACAAA | 73 | 1450 |
| 741453 | N/A | N/A | 93077 | 93093 | CCTTAACAATCTTATTT | 48 | 1451 |
| 741454 | N/A | N/A | 93302 | 93318 | CACCACATTAATTAAAC | 52 | 1452 |
| 741455 | N/A | N/A | 93527 | 93543 | ATGTTTTGAGTTCCAGG | 97 | 1453 |
| 741456 | N/A | N/A | 93752 | 93768 | TAATTAATAATCATCTT | 20 | 1454 |
| 741457 | N/A | N/A | 93950 | 93966 | TTCTGGCTGACTGAATT | 48 | 1455 |
| 741458 | N/A | N/A | 93953 | 93969 | GGCTTCTGGCTGACTGA | 72 | 180 |
| 741459 | N/A | N/A | 93954 | 93970 | TGGCTTCTGGCTGACTG | 83 | 1456 |
| 741460 | N/A | N/A | 93956 | 93972 | TGTGGCTTCTGGCTGAC | 66 | 1457 |
| 741461 | N/A | N/A | 93983 | 93999 | GGCTTTTAACAAAACAA | 69 | 1458 |
| 741462 | N/A | N/A | 94052 | 94068 | ATAATTCAAGTCAGGGA | 67 | 1459 |
| 741463 | N/A | N/A | 94054 | 94070 | CCATAATTCAAGTCAGG | 80 | 1460 |
| 741464 | N/A | N/A | 94055 | 94071 | GCCATAATTCAAGTCAG | 89 | 331 |
| 741465 | N/A | N/A | 94056 | 94072 | TGCCATAATTCAAGTCA | 66 | 1461 |
| 741466 | N/A | N/A | 94058 | 94074 | ACTGCCATAATTCAAGT | 64 | 1462 |
| 741467 | N/A | N/A | 94208 | 94224 | TAATATTGTGACCACTT | 94 | 1463 |
| 741468 | N/A | N/A | 94433 | 94449 | TAAGACTATTGCTTTGG | 74 | 1464 |
| 741469 | N/A | N/A | 94658 | 94674 | CATAATAGATGAGTTAA | 62 | 1465 |
| 741470 | N/A | N/A | 94993 | 95009 | TTCAGTTTTGTGGCGGG | 72 | 1466 |
| 741471 | N/A | N/A | 95218 | 95234 | ATTACATTAAAGGTGG | 39 | 1467 |

TABLE 22

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 97 | 33 |
| 740432 | 270 | 286 | 4721 | 4737 | AGTCCTTTCATGAATAC | 95 | 591 |
| 741472 | N/A | N/A | 95443 | 95459 | CCACCGTCACTGCATAC | 85 | 1468 |
| 741473 | N/A | N/A | 95668 | 95684 | ACTCTGTTGAATTTTCT | 80 | 1469 |
| 741474 | N/A | N/A | 95893 | 95909 | TTTCCAGTGCTAGTATT | 68 | 1470 |
| 741475 | N/A | N/A | 96118 | 96134 | AATGAGATGAAAATTGA | 70 | 1471 |
| 741476 | N/A | N/A | 96343 | 96359 | AGCTAGTTTGTAAACAA | 72 | 1472 |
| 741477 | N/A | N/A | 96568 | 96584 | AGAAGCAGTGAATCCAA | 84 | 1473 |
| 741478 | N/A | N/A | 96793 | 96809 | CTGTTAATCACCCCTTT | 60 | 1474 |
| 741479 | N/A | N/A | 97018 | 97034 | CACAATACAGAGCAGAG | 72 | 1475 |
| 741480 | N/A | N/A | 97243 | 97259 | AGAAGTCAGACTTCAGG | 33 | 1476 |
| 741481 | N/A | N/A | 97474 | 97490 | ATGGAAGATGAAAAGG | 3 | 1477 |
| 741482 | N/A | N/A | 97699 | 97715 | GTTGAGTCTGAGATGCC | 75 | 1478 |
| 741483 | N/A | N/A | 97924 | 97940 | AAGGCTGTTCACTATAT | 81 | 1479 |
| 741484 | N/A | N/A | 98149 | 98165 | TCTTGCACTGATTCCTC | 61 | 1480 |
| 741485 | N/A | N/A | 98374 | 98390 | AGATAAGAAGCAAATGC | 61 | 1481 |
| 741486 | N/A | N/A | 98805 | 98821 | GAATGGGCGGATCACAA | 34 | 1482 |
| 741487 | N/A | N/A | 99032 | 99048 | GATTATTTTAAGCACTT | 90 | 1483 |
| 741488 | N/A | N/A | 99257 | 99273 | AGAAAAGGGCATTTAA | 26 | 1484 |
| 741489 | N/A | N/A | 99483 | 99499 | TGCAATGTGTAGGTGGG | 70 | 1485 |
| 741490 | N/A | N/A | 99708 | 99724 | ACTTTTAAGGCATCCAT | 74 | 1486 |
| 741491 | N/A | N/A | 99933 | 99949 | CCCTCCCAACAATTTCA | 26 | 1487 |
| 741492 | N/A | N/A | 100158 | 100174 | CTTTCCATTATTGTTCT | 67 | 1488 |
| 741493 | N/A | N/A | 100391 | 100407 | GGAAATGTTTATATATA | 58 | 1489 |
| 741494 | N/A | N/A | 100625 | 100641 | TAGGAAGTCTGGCTCCA | 22 | 1490 |
| 741495 | N/A | N/A | 100850 | 100866 | GATAATGGGCTAGGTGT | 69 | 1491 |
| 741496 | N/A | N/A | 101075 | 101091 | TGGAATATCTTTGCTTA | 22 | 1492 |
| 741497 | N/A | N/A | 101300 | 101316 | ATAGCTTCAAGATCGGT | 72 | 1493 |
| 741498 | N/A | N/A | 101525 | 101541 | GAGATAAAGAGTCTGCT | 61 | 1494 |
| 741499 | N/A | N/A | 101803 | 101819 | TCACGGGATCACGCCAT | 58 | 1495 |
| 741500 | N/A | N/A | 102028 | 102044 | TGACTGAATAAGACATT | 52 | 1496 |
| 741501 | N/A | N/A | 102253 | 102269 | GCAACAACTGCCAGCTT | 54 | 1497 |
| 741502 | N/A | N/A | 102478 | 102494 | CAGGTTTAAATACATTC | 85 | 1498 |
| 741503 | N/A | N/A | 102703 | 102719 | TTGGATAATCTGTTACT | 63 | 1499 |
| 741504 | N/A | N/A | 102968 | 102984 | TAATGCAGTGATACAAT | 57 | 1500 |
| 741505 | N/A | N/A | 103193 | 103209 | CTGGATCACTTGGGAAT | 69 | 1501 |
| 741506 | N/A | N/A | 103418 | 103434 | TGTTCTAATTAAAAAGT | 47 | 1502 |

TABLE 22-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741507 | N/A | N/A | 103643 | 103659 | ACTTTACAACAAGATAA | 36 | 1503 |
| 741508 | N/A | N/A | 103868 | 103884 | TGATACATTATAATACA | 58 | 1504 |
| 741509 | N/A | N/A | 104093 | 104109 | GGGAAAGTATAGTTATG | 63 | 1505 |
| 741510 | N/A | N/A | 104332 | 104348 | GCATAAGAAAGAACAAT | 42 | 1506 |
| 741511 | N/A | N/A | 104557 | 104573 | TCTTGAGGTCATAAATC | 56 | 1507 |
| 741512 | N/A | N/A | 104782 | 104798 | AAATGAAGGCGATAGAC | 76 | 1508 |
| 741513 | N/A | N/A | 105007 | 105023 | CTAAAAAGAACTTTGA | 0 | 1509 |
| 741514 | N/A | N/A | 105232 | 105248 | TGTGTGATCAACTTTCA | 88 | 1510 |
| 741515 | N/A | N/A | 105457 | 105473 | AGTAAGCTTCAATTGGT | 71 | 1511 |
| 741516 | N/A | N/A | 105682 | 105698 | AGGTTTCATCAATTATC | 89 | 1512 |
| 741517 | N/A | N/A | 105907 | 105923 | AGTGTCTTGTTAAGTAT | 64 | 1513 |
| 741518 | N/A | N/A | 106134 | 106150 | GAATTTACATAATCTTT | 69 | 1514 |
| 741519 | N/A | N/A | 106361 | 106377 | CTTTTTAAATAAACCTG | 58 | 1515 |
| 741520 | N/A | N/A | 106586 | 106602 | GAATAGCTGTAGACTTT | 67 | 1516 |
| 741521 | N/A | N/A | 106811 | 106827 | TACCAATATAACAAATG | 23 | 1517 |
| 741522 | N/A | N/A | 107037 | 107053 | TATTTACTGTTTCATAA | 40 | 1518 |
| 741523 | N/A | N/A | 107275 | 107291 | TCAGGTGTCCTAGTGGG | 68 | 1519 |
| 741524 | N/A | N/A | 107500 | 107516 | GCAACCCCAAAATACTA | 62 | 1520 |
| 741525 | N/A | N/A | 107725 | 107741 | GTGTGATGATATATTGC | 85 | 1521 |
| 741526 | N/A | N/A | 107954 | 107970 | ACAAGACAAAGAATACG | 47 | 1522 |
| 741527 | N/A | N/A | 108273 | 108289 | GTTCTCCTATAGTCCCA | 24 | 1523 |
| 741528 | N/A | N/A | 108498 | 108514 | ACTAGGGATGACAGCAC | 74 | 1524 |
| 741529 | N/A | N/A | 108724 | 108740 | TTCTTGCTTATATCAAT | 72 | 1525 |
| 741530 | N/A | N/A | 108970 | 108986 | GCAGTAATGGAACAGCG | 63 | 1526 |
| 741531 | N/A | N/A | 109195 | 109211 | ATTTTGATATGGACCAG | 73 | 1527 |
| 741532 | N/A | N/A | 109420 | 109436 | TGCTGAGAAGTTTCCTA | 52 | 1528 |
| 741533 | N/A | N/A | 109645 | 109661 | TGCCCTTTTTATAAACT | 18 | 1529 |
| 741534 | N/A | N/A | 109870 | 109886 | AGCCTAAAGGGACTTGG | 49 | 1530 |
| 741535 | N/A | N/A | 110095 | 110111 | AGACTGAGACTATACAT | 65 | 1531 |
| 741536 | N/A | N/A | 110320 | 110336 | GTCTATATTATAGATAC | 16 | 1532 |
| 741537 | N/A | N/A | 110626 | 110642 | TTACAATGAAACCCCAT | 38 | 1533 |
| 741538 | N/A | N/A | 110853 | 110869 | TTTACTATTTAGGAAAT | 10 | 1534 |
| 741539 | N/A | N/A | 111078 | 111094 | AAGTAAGAAGCACAAAA | 20 | 1535 |
| 741540 | N/A | N/A | 111303 | 111319 | AACTTGCAAGTTGTCCA | 79 | 1536 |
| 741541 | N/A | N/A | 111528 | 111544 | GATTTCCCTAACTTTCC | 61 | 1537 |
| 741542 | N/A | N/A | 111986 | 112002 | ATGTCTCCTCTTCTGTT | 43 | 1538 |

TABLE 22-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741543 | N/A | N/A | 112211 | 112227 | GTAACCTGGCCACTTTG | 49 | 1539 |
| 741544 | N/A | N/A | 112436 | 112452 | TGTCTGTGTGAGACAGT | 31 | 1540 |
| 741545 | N/A | N/A | 112661 | 112677 | ATCATAATGAAGAAATG | 12 | 1541 |
| 741546 | N/A | N/A | 112886 | 112902 | TGCCTTTGCTTCTGATA | 63 | 1542 |
| 741547 | N/A | N/A | 113111 | 113127 | ATATCAGGATTCTGCTT | 52 | 1543 |
| 741548 | N/A | N/A | 113336 | 113352 | GATGCTCTAATTCTCAG | 61 | 1544 |

TABLE 23

Percent reduction of human SNCA mRNA with 4-9-4 MOE and cEt gapmers with mixed internucleoside linkages

| Compound No | SEQ ID No: 3 start | SEQ ID No: 3 stop | SEQ ID No: 5 start | SEQ ID No: 5 stop | SEQ ID No: 6 start | SEQ ID No: 6 stop | Sequence (5' to 3') | % Reduction | SEQ ID NO |
|---|---|---|---|---|---|---|---|---|---|
| 740914 | N/A | N/A | 31 | 47 | N/a | N/a | CACTCTTTCAGAGCTGG | 49 | 1545 |
| 740915 | N/A | N/A | 34 | 50 | N/a | N/a | CCACACTCTTTCAGAGC | 12 | 1546 |
| 740916 | N/A | N/A | 37 | 53 | N/a | N/a | ACACCACACTCTTTCAG | 37 | 1547 |
| 740917 | N/A | N/A | 40 | 56 | N/a | N/a | TTTACACCACACTCTTT | 55 | 1548 |
| 740918 | N/A | N/A | 41 | 57 | N/a | N/a | CTTTACACCACACTCTT | 70 | 1549 |
| 740919 | N/A | N/A | 43 | 59 | 98 | 114 | TCCTTTACACCACACTC | 89 | 1550 |
| 740920 | N/A | N/A | 90 | 106 | 90 | 106 | ACCACACTCACTTCCGC | 23 | 1551 |
| 740921 | N/A | N/A | 93 | 109 | 93 | 109 | TACACCACACTCACTTC | 0 | 1552 |
| 740922 | N/A | N/A | 96 | 112 | 96 | 112 | CTTTACACCACACTCAC | 86 | 1553 |
| 740923 | 370 | 386 | N/A | N/A | N/A | N/A | CACTACATAGAGAACAC | 86 | 1554 |
| 740924 | 373 | 389 | N/A | N/A | N/A | N/A | AGCCACTACATAGAGAA | 8 | 1555 |
| 740925 | 376 | 392 | N/A | N/A | N/A | N/A | CTCAGCCACTACATAGA | 29 | 1556 |
| 740926 | 379 | 395 | N/A | N/A | N/A | N/A | CTTCTCAGCCACTACAT | 52 | 1557 |
| 740927 | 382 | 398 | N/A | N/A | N/A | N/A | GGTCTTCTCAGCCACTA | 83 | 1558 |
| 740928 | 513 | 529 | N/A | N/A | N/A | N/A | TCCTTGCCCAACTGGTC | 46 | 1559 |
| 740929 | 516 | 532 | N/A | N/A | N/A | N/A | CCTTCCTTGCCCAACTG | 19 | 1560 |
| 740930 | 519 | 535 | N/A | N/A | N/A | N/A | TACCCTTCCTTGCCCAA | 50 | 1561 |
| 740931 | 522 | 538 | N/A | N/A | N/A | N/A | TGATACCCTTCCTTGCC | 16 | 1562 |
| 740932 | 525 | 541 | N/A | N/A | N/A | N/A | TCTTGATACCCTTCCTT | 63 | 1563 |

Example 4: Effect of 5-8-4 MOE and cEt Gapmers with Mixed Internucleoside Linkages on Human SNCA In Vitro, Single Dose Modified oligonucleotides complementary to a human SNCA nucleic acid were designed and tested for their effect on SNCA mRNA in vitro. The modified oligonucleotides were tested in a series of experiments that had similar culture conditions.

Cultured SH-SY5Y cells at a density of 20,000 cells per well were transfected using electroporation with 1,000 nM concentration of modified oligonucleotide or no modified oligonucleotide for untreated controls. After approximately 24 hours, RNA was isolated from the cells and SNCA mRNA levels were measured by quantitative real-time PCR using human primer probe set RTS2621 as described in Example 1. SNCA mRNA levels were adjusted according to total RNA content, as measured by RIBOGREEN®. Results are presented in the tables below as percent reduction of the amount of SNCA mRNA, relative to untreated control cells.

The modified oligonucleotides in tables 24-28 are 4-9-4 MOE and cEt gapmers. The gapmers are 17 nucleobases in length, wherein the central gap segment comprises nine 2'-deoxynucleosides and is flanked by wing segments on both the 5' end on the 3' end comprising two 2'-MOE nucleosides and two cEt nucleosides. The sugar motif for the gapmers is (from 5' to 3'): eekkddddddddddkkee; wherein 'd' represents a 2'-deoxyribose sugar; 'e' represents a 2'-MOE modified sugar; and 'k' represents a cEt modified sugar. All cytosine residues throughout each gapmer are 5-methyl cytosines. The internucleoside linkages are mixed phosphodiester and phosphorothioate linkages. The internucleoside linkage motif for the gapmers is (from 5' to 3'): sooosssssssssoss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the Tables below is complementary to human SNCA nucleic acid sequences SEQ ID NO: 1, SEQ ID NO: 2, SEQ ID NO: 3, SEQ ID NO: 4, SEQ ID NO: 5, or SEQ ID NO: 6, as indicated. 'N/A' indicates that the modified oligonucleotide is not complementary to that particular nucleic acid with 100% complementarity. A value of 0% reduction indicates that the compound had no effect or increased mRNA concentrations in the cell. As shown below, modified oligonucleotides complementary to human SNCA reduced the amount of human SNCA mRNA.

TABLE 24

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 61 | 33 |
| 740432 | 270 | 286 | 4721 | 4737 | AGTCCTTTCATGAATAC | 87 | 591 |
| 741010 | N/A | N/A | 20549 | 20565 | CAATTTCTAGGTTCTAT | 28 | 1107 |
| 741011 | N/A | N/A | 20559 | 20575 | AACTATGCTGCAATTTC | 28 | 1108 |
| 741012 | N/A | N/A | 20561 | 20577 | ACAACTATGCTGCAATT | 25 | 1109 |
| 741013 | N/A | N/A | 20562 | 20578 | CACAACTATGCTGCAAT | 54 | 314 |
| 741014 | N/A | N/A | 20565 | 20581 | TTCCACAACTATGCTGC | 51 | 1110 |
| 741015 | N/A | N/A | 20774 | 20790 | GACCACAATTGCAGACA | 55 | 1111 |
| 741016 | N/A | N/A | 20985 | 21001 | GTGTGAGCAAACATTCT | 73 | 1112 |
| 741017 | N/A | N/A | 27412 | 27428 | CAGTGTGAGCAAACATT | 35 | 1113 |
| | N/A | N/A | 20987 | 21003 | | | |
| 741018 | N/A | N/A | 27413 | 27429 | ACAGTGTGAGCAAACAT | 67 | 468 |
| | N/A | N/A | 20988 | 21004 | | | |
| 741019 | N/A | N/A | 27414 | 27430 | CACAGTGTGAGCAAACA | 61 | 1114 |
| | N/A | N/A | 20989 | 21005 | | | |
| 741020 | N/A | N/A | 20991 | 21007 | GGCACAGTGTGAGCAAA | 53 | 1115 |
| 741021 | N/A | N/A | 20999 | 21015 | AAGTTTCTGGCACAGTG | 89 | 1116 |
| 741022 | N/A | N/A | 21224 | 21240 | GTTCAGAATTATGTCAT | 81 | 1117 |
| 741023 | N/A | N/A | 21449 | 21465 | TCTTATGTGCACATGAG | 16 | 1118 |
| 741024 | N/A | N/A | 21674 | 21690 | CATAGTAGCATTACAGA | 47 | 1119 |
| 741025 | N/A | N/A | 21899 | 21915 | TCAGGCAGTGGCTTCAC | 43 | 1120 |
| 741026 | N/A | N/A | 22129 | 22145 | TAAAAAAGTTGTTCAT | 0 | 1121 |
| 741027 | N/A | N/A | 22360 | 22376 | CACTCAAGTGTTTAAAA | 26 | 1122 |
| 741028 | N/A | N/A | 22454 | 22470 | TGTGACCTGTGCTTGTT | 83 | 1123 |
| 741029 | N/A | N/A | 22456 | 22472 | CCTGTGACCTGTGCTTG | 87 | 1124 |
| 741030 | N/A | N/A | 22457 | 22473 | GCCTGTGACCTGTGCTT | 62 | 88 |

TABLE 24-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741031 | N/A | N/A | 22458 | 22474 | TGCCTGTGACCTGTGCT | 54 | 1125 |
| 741032 | N/A | N/A | 22460 | 22476 | GTTGCCTGTGACCTGTG | 78 | 1126 |
| 741033 | N/A | N/A | 22599 | 22615 | TATTAGACACTTAAGGG | 28 | 1127 |
| 741034 | N/A | N/A | 22831 | 22847 | TCAATCTTAAATTTTTC | 56 | 1128 |
| 741035 | N/A | N/A | 23056 | 23072 | GTACTTTCCCACCTAGA | 39 | 1129 |
| 741036 | N/A | N/A | 23281 | 23297 | TCTCAGAGACCACAGCT | 56 | 1130 |
| 741037 | N/A | N/A | 23285 | 23301 | TTGTTCTCAGAGACCAC | 86 | 1131 |
| 741038 | N/A | N/A | 23286 | 23302 | ATTGTTCTCAGAGACCA | 72 | 164 |
| 741039 | N/A | N/A | 23287 | 23303 | TATTGTTCTCAGAGACC | 67 | 1132 |
| 741040 | N/A | N/A | 23289 | 23305 | CATATTGTTCTCAGAGA | 40 | 1133 |
| 741041 | N/A | N/A | 23506 | 23522 | ACTATTAACCACTGATC | 25 | 1134 |
| 741042 | N/A | N/A | 23731 | 23747 | GTTGCAGTCCACAGAAT | 34 | 1135 |
| 741043 | N/A | N/A | 23956 | 23972 | TAAAGATAAGTATCTCA | 70 | 1136 |
| 741044 | N/A | N/A | 24181 | 24197 | AAACAAACCTAAGTCA | 0 | 1137 |
| 741045 | N/A | N/A | 24406 | 24422 | AAAAGCTAACAGCCTAT | 14 | 1138 |
| 741046 | N/A | N/A | 24631 | 24647 | TTAAATTGATGAGATGT | 49 | 1139 |
| 741047 | N/A | N/A | 24856 | 24872 | GTATTCTTTGCATTAGT | 67 | 1140 |
| 741048 | N/A | N/A | 25081 | 25097 | TAAAAGTGTACATTATT | 22 | 1141 |
| 741049 | N/A | N/A | 25306 | 25322 | CTCAAGGCAAAGCTGTA | 57 | 1142 |
| 741050 | N/A | N/A | 25531 | 25547 | TGCCACTATAAGCAGTC | 55 | 1143 |
| 741051 | N/A | N/A | 25756 | 25772 | TTCAAGCCCATGCCCTC | 21 | 1144 |
| 741052 | N/A | N/A | 25801 | 25817 | ATCCAGTAGAGTGAGAG | 37 | 1145 |
| 741053 | N/A | N/A | 25803 | 25819 | TCATCCAGTAGAGTGAG | 41 | 1146 |
| 741054 | N/A | N/A | 25804 | 25820 | ATCATCCAGTAGAGTGA | 31 | 315 |
| 741055 | N/A | N/A | 25807 | 25823 | GACATCATCCAGTAGAG | 55 | 1147 |
| 741056 | N/A | N/A | 25923 | 25939 | TGAATACATTGTCTTAA | 18 | 1148 |
| 741057 | N/A | N/A | 25925 | 25941 | ATTGAATACATTGTCTT | 41 | 1149 |
| 741058 | N/A | N/A | 25926 | 25942 | AATTGAATACATTGTCT | 50 | 392 |
| 741059 | N/A | N/A | 25927 | 25943 | TAATTGAATACATTGTC | 29 | 1150 |
| 741060 | N/A | N/A | 25929 | 25945 | CATAATTGAATACATTG | 25 | 1151 |
| 741061 | N/A | N/A | 25981 | 25997 | TGAGTAGCTATGGTTTA | 37 | 1152 |
| 741062 | N/A | N/A | 26202 | 26218 | TCTTTGTGTTATACAAT | 0 | 1153 |
| 741063 | N/A | N/A | 26204 | 26220 | CCTCTTTGTGTTATACA | 53 | 1154 |
| 741064 | N/A | N/A | 26205 | 26221 | CCCTCTTTGTGTTATAC | 42 | 469 |
| 741065 | N/A | N/A | 26206 | 26222 | TCCCTCTTTGTGTTATA | 20 | 1155 |
| 741066 | N/A | N/A | 26208 | 26224 | TTTCCCTCTTTGTGTTA | 30 | 1156 |

TABLE 24-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741067 | N/A | N/A | 26431 | 26447 | TACATACAATATTAAGG | 0 | 1157 |
| 741068 | N/A | N/A | 26656 | 26672 | AAAAGAATGGATTCTGA | 34 | 1158 |
| 741069 | N/A | N/A | 26881 | 26897 | AAGGAAAAACTCTGCCC | 15 | 1159 |
| 741070 | N/A | N/A | 27106 | 27122 | TCACCCCAAGGCATTTG | 6 | 1160 |
| 741071 | N/A | N/A | 27331 | 27347 | ACACCCTGATTCCCAAG | 31 | 1161 |
| 741072 | N/A | N/A | 27410 | 27426 | GTGTGAGCAAACATTCA | 52 | 1162 |
| 741073 | N/A | N/A | 27416 | 27432 | GTCACAGTGTGAGCAAA | 72 | 1163 |
| 741074 | N/A | N/A | 27556 | 27572 | GGGAAGTATTAGTGGAA | 27 | 1164 |
| 741075 | N/A | N/A | 27782 | 27798 | GCTGAAAATATGAAACA | 32 | 1165 |
| 741076 | N/A | N/A | 28007 | 28023 | ACTTCTAGCACTATTTT | 9 | 1166 |
| 741077 | N/A | N/A | 28232 | 28248 | TTGTGCATTTATTCCAC | 78 | 1167 |
| 741078 | N/A | N/A | 28457 | 28473 | GACTGTAATCTAGGACC | 74 | 1168 |
| 741079 | N/A | N/A | 28682 | 28698 | TGACTTTTGAATCAGTC | 14 | 1169 |
| 741080 | N/A | N/A | 29010 | 29026 | GAGCGATTCTCCTGGTT | 61 | 1170 |
| 741081 | N/A | N/A | 29235 | 29251 | CACAGTCCATAATATTG | 34 | 1171 |
| 741082 | N/A | N/A | 29460 | 29476 | TTTTTGTTAATAGTTCT | 73 | 1172 |
| 741083 | N/A | N/A | 29685 | 29701 | GCTTTCTCAGAGCCCAA | 74 | 1173 |
| 741084 | N/A | N/A | 29912 | 29928 | ATCTCTCTACCATGTGA | 34 | 1174 |
| 741085 | N/A | N/A | 30137 | 30153 | GTGGATAAAGTACATTA | 16 | 1175 |
| 741086 | N/A | N/A | 30362 | 30378 | AAATGGTATTCAGAGAT | 42 | 1176 |

TABLE 25

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 55 | 33 |
| 740432 | 270 | 286 | 4721 | 4737 | AGTCCTTTCATGAATAC | 84 | 591 |
| 741087 | N/A | N/A | 30587 | 30603 | TTTTCTCCTAAAGCCTT | 42 | 1177 |
| 741088 | N/A | N/A | 31037 | 31053 | CAGATTTCCAGCACACT | 30 | 1178 |
| 741089 | N/A | N/A | 31262 | 31278 | CCTTCTTAGTGGTAAGA | 0 | 1179 |
| 741090 | N/A | N/A | 31487 | 31503 | AATTACAGTGTAGGTAA | 18 | 1180 |
| 741091 | N/A | N/A | 31712 | 31728 | ATAAGAGGTCACTGGAT | 25 | 1181 |
| 741092 | N/A | N/A | 31937 | 31953 | AAGGAAACAGTCTACAT | 14 | 1182 |
| 741093 | N/A | N/A | 32162 | 32178 | CTATCATGATAAGTATA | 10 | 1183 |
| 741094 | N/A | N/A | 32387 | 32403 | TGTGGTTCTGCCCATCT | 54 | 1184 |
| 741095 | N/A | N/A | 32624 | 32640 | GCCTAAACATTTTACTT | 5 | 1185 |

TABLE 25-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741096 | N/A | N/A | 32858 | 32874 | GAAGTTTCTGAAGAAAT | 40 | 1186 |
| 741097 | N/A | N/A | 33083 | 33099 | TTTTCAGTAGATTTGAC | 24 | 1187 |
| 741098 | N/A | N/A | 33308 | 33324 | GCTATGACCCTCAAGCC | 11 | 1188 |
| 741099 | N/A | N/A | 33533 | 33549 | AATAGAGCAAAATTTCG | 35 | 1189 |
| 741100 | N/A | N/A | 33762 | 33778 | ATAATCAAACAAAAGGG | 16 | 1190 |
| 741101 | N/A | N/A | 33987 | 34003 | AAAGTTCAATGCTGTGT | 69 | 1191 |
| 741102 | N/A | N/A | 34212 | 34228 | GAAATGGGCATGTAAAC | 10 | 1192 |
| 741103 | N/A | N/A | 34443 | 34459 | CAAAATACAATGTTCAA | 15 | 1193 |
| 741104 | N/A | N/A | 34668 | 34684 | ATTCTTCTATCCTAGAA | 5 | 1194 |
| 741105 | N/A | N/A | 34893 | 34909 | ATTATCATGGTTGCCCA | 38 | 1195 |
| 741106 | N/A | N/A | 35118 | 35134 | ATGAGATCTTTTTGCAT | 39 | 1196 |
| 741107 | N/A | N/A | 35343 | 35359 | AAGCAAGTTGTCCATGG | 47 | 1197 |
| 741108 | N/A | N/A | 35568 | 35584 | TGTTGGAGTTTACAATT | 20 | 1198 |
| 741109 | N/A | N/A | 35793 | 35809 | CTCACTAGCCCTGTGAC | 0 | 1199 |
| 741110 | N/A | N/A | 36018 | 36034 | TCTCTTTCATGGGTATT | 57 | 1200 |
| 741111 | N/A | N/A | 36252 | 36268 | GTCATTTTAATAAGTGT | 65 | 1201 |
| 741112 | N/A | N/A | 36484 | 36500 | CAATTAAATAAACCTCT | 10 | 1202 |
| 741113 | N/A | N/A | 36790 | 36806 | TATGGTGATATGGTTAG | 53 | 1203 |
| 741114 | N/A | N/A | 37018 | 37034 | CCATGTGTTTTTGTGGC | 33 | 1204 |
| 741115 | N/A | N/A | 37243 | 37259 | CAAAGGTATAAGGTCAT | 49 | 1205 |
| 741116 | N/A | N/A | 37468 | 37484 | AGCTTGTATTTTTGAAA | 24 | 1206 |
| 741117 | N/A | N/A | 37788 | 37804 | CGCATCTGTCTTTCTTT | 25 | 1207 |
| 741118 | N/A | N/A | 38013 | 38029 | TAGGACAGGTGAAATAA | 12 | 1208 |
| 741119 | N/A | N/A | 38238 | 38254 | AGTTATTAGAATAACAC | 0 | 1209 |
| 741120 | N/A | N/A | 38464 | 38480 | AATAAAATGTCTTAATC | 0 | 1210 |
| 741121 | N/A | N/A | 38691 | 38707 | ACTCAAAAAGAAGAAT | 0 | 1211 |
| 741122 | N/A | N/A | 38916 | 38932 | GTTTTCTCTGTATTGGC | 87 | 1212 |
| 741123 | N/A | N/A | 39141 | 39157 | TGGCCTAGTGGTTATAA | 0 | 1213 |
| 741124 | N/A | N/A | 39366 | 39382 | CACAAAGAGGAAACAGG | 27 | 1214 |
| 741125 | N/A | N/A | 39591 | 39607 | ACATTTTTAACTGGAT | 76 | 1215 |
| 741126 | N/A | N/A | 39816 | 39832 | AGGCTAAATTTTAATAA | 0 | 1216 |
| 741127 | N/A | N/A | 40041 | 40057 | TAGCCTTTCATAGTACG | 38 | 1217 |
| 741128 | N/A | N/A | 40266 | 40282 | AAGAGGAAAAGCTTGGA | 0 | 1218 |
| 741129 | N/A | N/A | 40491 | 40507 | AAAAATTCTGGTGCCAA | 57 | 1219 |
| 741130 | N/A | N/A | 40716 | 40732 | AAGCTAAACTACCGCTG | 2 | 1220 |
| 741131 | N/A | N/A | 40941 | 40957 | GAATTTCCTGGATGCTC | 44 | 1221 |

TABLE 25-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741132 | N/A | N/A | 41130 | 41146 | AGATTCCAGCAGAGATT | 20 | 1222 |
| 741133 | N/A | N/A | 41132 | 41148 | ACAGATTCCAGCAGAGA | 44 | 1223 |
| 741134 | N/A | N/A | 41133 | 41149 | AACAGATTCCAGCAGAG | 40 | 90 |
| 741135 | N/A | N/A | 41134 | 41150 | GAACAGATTCCAGCAGA | 24 | 1224 |
| 741136 | N/A | N/A | 41136 | 41152 | GTGAACAGATTCCAGCA | 34 | 1225 |
| 741137 | N/A | N/A | 41166 | 41182 | ATCTGTAAGAAGTTTAG | 10 | 1226 |
| 741138 | N/A | N/A | 41391 | 41407 | TGAGAAATTTTATGGGT | 47 | 1227 |
| 741139 | N/A | N/A | 41620 | 41636 | TCATTCAAAACCATCCT | 21 | 1228 |
| 741140 | N/A | N/A | 41845 | 41861 | GATCACACTGCTTATAG | 16 | 1229 |
| 741141 | N/A | N/A | 42070 | 42086 | CAAGTTGATGGCATATA | 34 | 1230 |
| 741142 | N/A | N/A | 42295 | 42311 | GTGTACCAACCTCAAGT | 34 | 1231 |
| 741143 | N/A | N/A | 42532 | 42548 | TAAGTAAATACCTAGGG | 20 | 1232 |
| 741144 | N/A | N/A | 42757 | 42773 | GATTTGTGCCTGGCATC | 38 | 1233 |
| 741145 | N/A | N/A | 42835 | 42851 | TGCCTCTACCTCCAGCA | 39 | 1234 |
| 741146 | N/A | N/A | 42837 | 42853 | GATGCCTCTACCTCCAG | 42 | 1235 |
| 741147 | N/A | N/A | 42838 | 42854 | TGATGCCTCTACCTCCA | 40 | 166 |
| 741148 | N/A | N/A | 42839 | 42855 | CTGATGCCTCTACCTCC | 33 | 1236 |
| 741149 | N/A | N/A | 42982 | 42998 | TATCACAACTACATTGT | 0 | 1237 |
| 741150 | N/A | N/A | 43208 | 43224 | GGCCTCCTGCTGCAGCA | 0 | 1238 |
| 741151 | N/A | N/A | 43440 | 43456 | GCACTCATTTTAAATGT | 20 | 1239 |
| 741152 | N/A | N/A | 43665 | 43681 | TGGTAACTTAGGACAAG | 44 | 1240 |
| 741153 | N/A | N/A | 43818 | 43834 | TTCTCTGGACCTCTTAA | 6 | 1241 |
| 741154 | N/A | N/A | 43820 | 43836 | ACTTCTCTGGACCTCTT | 41 | 1242 |
| 741155 | N/A | N/A | 43821 | 43837 | TACTTCTCTGGACCTCT | 49 | 242 |
| 741156 | N/A | N/A | 43822 | 43838 | TTACTTCTCTGGACCTC | 44 | 1243 |
| 741157 | N/A | N/A | 43890 | 43906 | TCAATACAACTTAATTC | 0 | 1244 |
| 741158 | N/A | N/A | 44376 | 44392 | TTGGGCTGGAAGCAGTG | 9 | 1245 |
| 741159 | N/A | N/A | 44601 | 44617 | AAGATATGCAGAGGGTT | 49 | 1246 |
| 741160 | N/A | N/A | 44828 | 44844 | TGGTCTAACTGTGTTGC | 40 | 1247 |
| 741161 | N/A | N/A | 45053 | 45069 | GTTTATGGACTTTTTAA | 29 | 1248 |
| 741162 | N/A | N/A | 45278 | 45294 | TTTTGTACTTTATGGAA | 40 | 1249 |
| 741163 | N/A | N/A | 45503 | 45519 | ACTTCTCCTTCAATTAA | 11 | 1250 |

TABLE 26

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 64 | 33 |
| 740432 | 270 | 286 | 4721 | 4737 | AGTCCTTTCATGAATAC | 82 | 591 |
| 741164 | N/A | N/A | 45728 | 45744 | GTCAAAATATTCTTACT | 30 | 1564 |
| 741165 | N/A | N/A | 45953 | 45969 | CACATAAAATTAAAGCT | 2 | 1565 |
| 741166 | N/A | N/A | 46157 | 46173 | TCCATGAAGCCAAGTAA | 38 | 1566 |
| 741167 | N/A | N/A | 46159 | 46175 | TTTCCATGAAGCCAAGT | 74 | 1567 |
| 741168 | N/A | N/A | 53645 | 53661 | ATTTCCATGAAGCCAAG | 67 | 317 |
|  | N/A | N/A | 46160 | 46176 |  |  |  |
| 741169 | N/A | N/A | 46161 | 46177 | GATTTCCATGAAGCCAA | 84 | 1568 |
| 741170 | N/A | N/A | 46163 | 46179 | GAGATTTCCATGAAGCC | 87 | 1569 |
| 741171 | N/A | N/A | 46178 | 46194 | GGAATTGGAGTGAGAGA | 29 | 1570 |
| 741172 | N/A | N/A | 46403 | 46419 | ATCCCTACATACTCACA | 20 | 1571 |
| 741173 | N/A | N/A | 46628 | 46644 | TTCTACCACCCACAGCT | 0 | 1572 |
| 741174 | N/A | N/A | 46880 | 46896 | GAAAACATTGTATTATT | 39 | 1573 |
| 741175 | N/A | N/A | 47105 | 47121 | CCTTAAAATGATGCCTG | 43 | 1574 |
| 741176 | N/A | N/A | 47330 | 47346 | CTAAAGTTAAGGTGTCG | 25 | 1575 |
| 741177 | N/A | N/A | 47557 | 47573 | GCATGAATTACTTTACG | 40 | 1576 |
| 741178 | N/A | N/A | 47952 | 47968 | GGTTGTTCAAGTGATTC | 58 | 1577 |
| 741179 | N/A | N/A | 48177 | 48193 | GATCTTTTCATCATGCC | 75 | 1578 |
| 741180 | N/A | N/A | 48225 | 48241 | GGTCATGACTCTGACAC | 14 | 1579 |
| 741181 | N/A | N/A | 48227 | 48243 | CTGGTCATGACTCTGAC | 34 | 1580 |
| 741182 | N/A | N/A | 48228 | 48244 | CCTGGTCATGACTCTGA | 39 | 394 |
| 741183 | N/A | N/A | 48229 | 48245 | CCCTGGTCATGACTCTG | 46 | 1581 |
| 741184 | N/A | N/A | 48231 | 48247 | TCCCCTGGTCATGACTC | 35 | 1582 |
| 741185 | N/A | N/A | 48402 | 48418 | AGGGCCATCCTGTTCAA | 9 | 1583 |
| 741186 | N/A | N/A | 48648 | 48664 | AGAATACTTATTTTTG | 14 | 1584 |
| 741187 | N/A | N/A | 48713 | 48729 | ATTTTGGATGCTTCTGA | 56 | 1585 |
| 741188 | N/A | N/A | 48715 | 48731 | GTATTTTGGATGCTTCT | 70 | 1586 |
| 741189 | N/A | N/A | 48716 | 48732 | TGTATTTTGGATGCTTC | 80 | 471 |
| 741190 | N/A | N/A | 48717 | 48733 | TTGTATTTTGGATGCTT | 78 | 1587 |
| 741191 | N/A | N/A | 48719 | 48735 | GTTTGTATTTTGGATGC | 69 | 1588 |
| 741192 | N/A | N/A | 48873 | 48889 | TTTAAAGATGGATATTG | 0 | 1589 |
| 741193 | N/A | N/A | 49111 | 49127 | TAAGGTCCCTCCCTCAA | 0 | 1590 |
| 741194 | N/A | N/A | 49373 | 49389 | TTACCTGGCTACCTTTT | 31 | 1591 |
| 741195 | N/A | N/A | 49480 | 49496 | TGAAATTTTCCAGCTAT | 60 | 1592 |
| 741196 | N/A | N/A | 80992 | 81008 | TTGAAATTTTCCAGCTA | 37 | 167 |
|  | N/A | N/A | 49481 | 49497 |  |  |  |
| 741197 | N/A | N/A | 49482 | 49498 | ATTGAAATTTTCCAGCT | 60 | 1593 |

TABLE 26-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741198 | N/A | N/A | 49484 | 49500 | TGATTGAAATTTTCCAG | 33 | 1594 |
| 741199 | N/A | N/A | 49598 | 49614 | TGGGAATCACCTCCCCT | 14 | 1595 |
| 741200 | N/A | N/A | 49825 | 49841 | CATTGAATTAATTTGTT | 30 | 1596 |
| 741201 | N/A | N/A | 50050 | 50066 | CACCATTTTATAGCATG | 64 | 1597 |
| 741202 | N/A | N/A | 50275 | 50291 | TGGAAAGAGGTATGAGT | 0 | 1598 |
| 741203 | N/A | N/A | 50500 | 50516 | ATTAAAATGAGAGGTCC | 18 | 1599 |
| 741204 | N/A | N/A | 50725 | 50741 | TTCCACCACACAAGTTA | 43 | 1600 |
| 741205 | N/A | N/A | 50920 | 50936 | TTCATCAATATCTGCAA | 66 | 1601 |
| 741206 | N/A | N/A | 50921 | 50937 | TTTCATCAATATCTGCA | 85 | 243 |
| 741207 | N/A | N/A | 50922 | 50938 | TTTTCATCAATATCTGC | 86 | 1602 |
| 741208 | N/A | N/A | 50924 | 50940 | GGTTTTCATCAATATCT | 76 | 1603 |
| 741209 | N/A | N/A | 50950 | 50966 | CTTTGATGAATTAAGAG | 22 | 1604 |
| 741210 | N/A | N/A | 51175 | 51191 | AGGTATAAGATTCCTGC | 31 | 1605 |
| 741211 | N/A | N/A | 51412 | 51428 | ACAAGGCCTTACTTACG | 9 | 1606 |
| 741212 | N/A | N/A | 51637 | 51653 | CTGCCCAACTTACAATT | 9 | 1607 |
| 741213 | N/A | N/A | 51868 | 51884 | CATGGCAAGAACAAGGG | 27 | 1608 |
| 741214 | N/A | N/A | 52093 | 52109 | TATTATGTGCTTATTGG | 56 | 1609 |
| 741215 | N/A | N/A | 52318 | 52334 | CCTAACACATGGATGTA | 5 | 1610 |
| 741216 | N/A | N/A | 52417 | 52433 | CAAATGTATAGAGAAGT | 15 | 1611 |
| 741217 | N/A | N/A | 52419 | 52435 | ATCAAATGTATAGAGAA | 41 | 1612 |
| 741218 | N/A | N/A | 52420 | 52436 | GATCAAATGTATAGAGA | 36 | 395 |
| 741219 | N/A | N/A | 52421 | 52437 | AGATCAAATGTATAGAG | 31 | 1613 |
| 741220 | N/A | N/A | 52423 | 52439 | ACAGATCAAATGTATAG | 55 | 1614 |
| 741221 | N/A | N/A | 52543 | 52559 | CTCTACTGTGTTTGAGC | 14 | 1615 |
| 741222 | N/A | N/A | 52768 | 52784 | CTATATACTACAATTTT | 7 | 1616 |
| 741223 | N/A | N/A | 52993 | 53009 | TGAGCTCACTGACAGAA | 13 | 1617 |
| 741224 | N/A | N/A | 53239 | 53255 | CAAGTATAAATATGTTT | 10 | 1618 |
| 741225 | N/A | N/A | 53464 | 53480 | CCAAGGAGCATTTGGAT | 7 | 1619 |
| 741226 | N/A | N/A | 53642 | 53658 | TCCATGAAGCCAAGATC | 52 | 1620 |
| 741227 | N/A | N/A | 53644 | 53660 | TTTCCATGAAGCCAAGA | 65 | 1621 |
| 741228 | N/A | N/A | 53646 | 53662 | TATTTCCATGAAGCCAA | 79 | 1622 |
| 741229 | N/A | N/A | 53648 | 53664 | ATTATTTCCATGAAGCC | 81 | 1623 |
| 741230 | N/A | N/A | 53689 | 53705 | ATCCATAAATGCTTTGT | 68 | 1624 |
| 741231 | N/A | N/A | 53914 | 53930 | TATCTTCATCATAGCTC | 60 | 1625 |
| 741232 | N/A | N/A | 54139 | 54155 | AGACCACACTCCAACTA | 20 | 1626 |
| 741233 | N/A | N/A | 54364 | 54380 | ATGTAAGGATGATCATT | 32 | 1627 |

TABLE 26-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741234 | N/A | N/A | 54589 | 54605 | TGACTTTATATGCATTT | 54 | 1628 |
| 741235 | N/A | N/A | 54814 | 54830 | CATATATACTTACTTAC | 2 | 1629 |
| 741236 | N/A | N/A | 55039 | 55055 | ATATGTTTGATCGAAAG | 20 | 1630 |
| 741237 | N/A | N/A | 55269 | 55285 | CAGATGGTTTTTCTTT | 31 | 1631 |
| 741238 | N/A | N/A | 55494 | 55510 | ACAAAAGGGATTGTTCT | 8 | 1632 |
| 741239 | N/A | N/A | 55719 | 55735 | ACTTGACTATAACACTT | 40 | 1633 |
| 741240 | N/A | N/A | 56172 | 56188 | ATAGAAAACAGATGAAG | 2 | 1634 |

TABLE 27

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 57 | 33 |
| 740432 | 270 | 286 | 4721 | 4737 | AGTCCTTTCATGAATAC | 87 | 591 |
| 741241 | N/A | N/A | 56397 | 56413 | AAAATTTTTGCACACTT | 46 | 1251 |
| 741242 | N/A | N/A | 56622 | 56638 | GCCAAATCAATGGATGA | 33 | 1252 |
| 741243 | N/A | N/A | 56847 | 56863 | AGTGACCAAGAGAATGA | 4 | 1253 |
| 741244 | N/A | N/A | 57072 | 57088 | TTTTAAAACACTGGCCT | 0 | 1254 |
| 741245 | N/A | N/A | 57297 | 57313 | TAGGATTAAACAGTCCA | 0 | 1255 |
| 741246 | N/A | N/A | 57522 | 57538 | TTATCTGTTGCTATGTG | 51 | 1256 |
| 741247 | N/A | N/A | 57747 | 57763 | AAGAAGGAGAATAGCAG | 14 | 1257 |
| 741248 | N/A | N/A | 57981 | 57997 | CGGGCAAACATGTTTTG | 8 | 1258 |
| 741249 | N/A | N/A | 58206 | 58222 | ATGACCTACATGCTAAA | 11 | 1259 |
| 741250 | N/A | N/A | 58431 | 58447 | AGAAGCAAAATGTCAGT | 40 | 1260 |
| 741251 | N/A | N/A | 58656 | 58672 | CCTAACAGCTTTACTTT | 0 | 1261 |
| 741252 | N/A | N/A | 58881 | 58897 | CTTTCACACATCTCTAA | 0 | 1262 |
| 741253 | N/A | N/A | 58991 | 59007 | TTTCATTAATCTGTGAA | 14 | 1263 |
| 741254 | N/A | N/A | 58992 | 59008 | ATTTCATTAATCTGTGA | 20 | 169 |
| 741255 | N/A | N/A | 58993 | 59009 | TATTTCATTAATCTGTG | 39 | 1264 |
| 741256 | N/A | N/A | 58995 | 59011 | TATATTTCATTAATCTG | 27 | 1265 |
| 741257 | N/A | N/A | 59106 | 59122 | CCTTACACAAAATATAA | 0 | 1266 |
| 741258 | N/A | N/A | 59354 | 59370 | ACACCAATATATTATTT | 13 | 1267 |
| 741259 | N/A | N/A | 59594 | 59610 | TAAAGGATGCAAAGGCA | 0 | 1268 |
| 741260 | N/A | N/A | 59948 | 59964 | TTCCAGCGATCCCACTC | 21 | 1269 |
| 741261 | N/A | N/A | 60173 | 60189 | CTCAACATCTTTAATGA | 6 | 1270 |
| 741262 | N/A | N/A | 60421 | 60437 | GGGACCTAAAACTATAA | 0 | 1271 |

TABLE 27-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741263 | N/A | N/A | 60758 | 60774 | AGCAGAATAGAAAATCC | 14 | 1272 |
| 741264 | N/A | N/A | 60983 | 60999 | TTCAATGCGACTCCCAT | 23 | 1273 |
| 741265 | N/A | N/A | 61216 | 61232 | CAACAAAACTGAGAATC | 0 | 1274 |
| 741266 | N/A | N/A | 61474 | 61490 | AATGCCTGCTTTCACCA | 26 | 1275 |
| 741267 | N/A | N/A | 61699 | 61715 | TATAAGCAGGAGTAAAA | 2 | 1276 |
| 741268 | N/A | N/A | 61969 | 61985 | GTTCCAAAGATAGAGA | 11 | 1277 |
| 741269 | N/A | N/A | 62200 | 62216 | CGTACACAAACTAGAAA | 1 | 1278 |
| 741270 | N/A | N/A | 62492 | 62508 | TACTGTTGCATTCCAGC | 6 | 1279 |
| 741271 | N/A | N/A | 62729 | 62745 | TCTTAGTGTGGTGGCTC | 15 | 1280 |
| 741272 | N/A | N/A | 62955 | 62971 | TCAACAATAATAATGAC | 0 | 1281 |
| 741273 | N/A | N/A | 63197 | 63213 | CCTTTTCATCAACACAT | 12 | 1282 |
| 741274 | N/A | N/A | 63422 | 63438 | TATGCATCTAACACTTG | 8 | 1283 |
| 741275 | N/A | N/A | 63666 | 63682 | CCATCAACCAAGTATCT | 0 | 1284 |
| 741276 | N/A | N/A | 63891 | 63907 | CTTGAAACAGTAACTTG | 0 | 1285 |
| 741277 | N/A | N/A | 64116 | 64132 | AACATAGCAGATTAATA | 12 | 1286 |
| 741278 | N/A | N/A | 64349 | 64365 | TCATGTTATATAGTGGG | 73 | 1287 |
| 741279 | N/A | N/A | 64574 | 64590 | TGTAACCTAATGTAAAT | 0 | 1288 |
| 741280 | N/A | N/A | 64799 | 64815 | ACAAGTATCTGTACTCA | 59 | 1289 |
| 741281 | N/A | N/A | 65024 | 65040 | GTCTCTGTTAATGTTGG | 26 | 1290 |
| 741282 | N/A | N/A | 65249 | 65265 | GAACCAGCCTGACTTAA | 21 | 1291 |
| 741283 | N/A | N/A | 65474 | 65490 | TTGTATGGGTTACATAA | 3 | 1292 |
| 741284 | N/A | N/A | 65801 | 65817 | CAATTAAATGCAATTCC | 0 | 1293 |
| 741285 | N/A | N/A | 66026 | 66042 | TGACAGAAGTGTGCATA | 14 | 1294 |
| 741286 | N/A | N/A | 66251 | 66267 | CAACACATCCACATTGC | 8 | 1295 |
| 741287 | N/A | N/A | 66476 | 66492 | TTCACACCTCTCTCCCT | 0 | 1296 |
| 741288 | N/A | N/A | 66701 | 66717 | TGCTGGTCTAAGATGCA | 24 | 1297 |
| 741289 | N/A | N/A | 66926 | 66942 | ATGTGTTTGAGGAAAA | 13 | 1298 |
| 741290 | N/A | N/A | 67151 | 67167 | CAGAAGTAAATGTGGAC | 24 | 1299 |
| 741291 | N/A | N/A | 67376 | 67392 | TGATTCTTTGGATTCAT | 27 | 1300 |
| 741292 | N/A | N/A | 67876 | 67892 | CATTCTTGTTTTTATTC | 37 | 1301 |
| 741293 | N/A | N/A | 68101 | 68117 | AATAGTGTCCCAGTGTA | 40 | 1302 |
| 741294 | N/A | N/A | 68326 | 68342 | TGAAAGCTGTTCAGTTA | 12 | 1303 |
| 741295 | N/A | N/A | 68551 | 68567 | CCCACATATACTACTTG | 32 | 1304 |
| 741296 | N/A | N/A | 68776 | 68792 | AGAATTTCAGGAAGTTA | 33 | 1305 |
| 741297 | N/A | N/A | 68798 | 68814 | CAAAGTAAGAGGAGATT | 13 | 1306 |
| 741298 | N/A | N/A | 68800 | 68816 | GCCAAAGTAAGAGGAGA | 37 | 1307 |

TABLE 27-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741299 | N/A | N/A | 68801 | 68817 | TGCCAAAGTAAGAGGAG | 11 | 397 |
| 741300 | N/A | N/A | 68804 | 68820 | CAGTGCCAAAGTAAGAG | 0 | 1308 |
| 741301 | N/A | N/A | 69001 | 69017 | TGAATCCATTTGTCCAG | 52 | 1309 |
| 741302 | N/A | N/A | 69227 | 69243 | CTCTAAAATACAAATGT | 13 | 1310 |
| 741303 | N/A | N/A | 69452 | 69468 | GAACAAAGGAATAAGTA | 0 | 1311 |
| 741304 | N/A | N/A | 69677 | 69693 | CTAGATGTAGATATCAT | 13 | 1312 |
| 741305 | N/A | N/A | 69902 | 69918 | AAGGGAATAAATTGTAG | 28 | 1313 |
| 741306 | N/A | N/A | 70127 | 70143 | CAACAGACCCTTTCAAT | 3 | 1314 |
| 741307 | N/A | N/A | 70352 | 70368 | GTCTTCCCACTGCCTAC | 7 | 1315 |
| 741308 | N/A | N/A | 70577 | 70593 | TTTAGATATACCTCCAA | 37 | 1316 |
| 741309 | N/A | N/A | 70880 | 70896 | GCTTCAGTTTCTTGAGT | 18 | 1317 |
| 741310 | N/A | N/A | 71105 | 71121 | CTGGTCTTTCTCACAAT | 8 | 1318 |
| 741311 | N/A | N/A | 71375 | 71391 | ATCATTCTTAACAGAAA | 15 | 1319 |
| 741312 | N/A | N/A | 71600 | 71616 | GCTCTTGCTGTGCAGCC | 11 | 1320 |
| 741313 | N/A | N/A | 71844 | 71860 | ATTTAAAGCAGCAGTCC | 4 | 1321 |
| 741314 | N/A | N/A | 72076 | 72092 | AGGTAATTCTAATTTTA | 17 | 1322 |
| 741315 | N/A | N/A | 72301 | 72317 | GGCAAATGACAGGGTCT | 69 | 1323 |
| 741316 | N/A | N/A | 72632 | 72648 | TCTCAACTGCCTGAGTA | 0 | 1324 |
| 741317 | N/A | N/A | 72857 | 72873 | CATGTCAGCTTTTAGT | 19 | 1325 |

TABLE 28

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 57 | 33 |
| 740432 | 270 | 286 | 4721 | 4737 | AGTCCTTTCATGAATAC | 85 | 591 |
| 741318 | N/A | N/A | 73090 | 73106 | ATACTCAGATATTTAAA | 0 | 1326 |
| 741319 | N/A | N/A | 73188 | 73204 | ACTTTCTGTGTGGTATG | 42 | 1327 |
| 741320 | N/A | N/A | 73190 | 73206 | AGACTTTCTGTGTGGTA | 59 | 1328 |
| 741321 | N/A | N/A | 73191 | 73207 | CAGACTTTCTGTGTGGT | 83 | 170 |
| 741322 | N/A | N/A | 73192 | 73208 | ACAGACTTTCTGTGTGG | 37 | 1329 |
| 741323 | N/A | N/A | 73194 | 73210 | AGACAGACTTTCTGTGT | 0 | 1330 |
| 741324 | N/A | N/A | 73315 | 73331 | GTTGAGAATTTTTCATT | 14 | 1331 |
| 741325 | N/A | N/A | 73540 | 73556 | AGTTATGGAGCATCTTT | 46 | 1332 |
| 741326 | N/A | N/A | 73765 | 73781 | GACTGAGTTTTTATTC | 16 | 1333 |
| 741327 | N/A | N/A | 73990 | 74006 | TCCTGAATTAAAAATTT | 0 | 1334 |

TABLE 28-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741328 | N/A | N/A | 74215 | 74231 | GCTAAGCACAAACAATT | 15 | 1335 |
| 741329 | N/A | N/A | 74292 | 74308 | GAACTCTGTAGTCAGAA | 58 | 1336 |
| 741330 | N/A | N/A | 74294 | 74310 | TAGAACTCTGTAGTCAG | 63 | 1337 |
| 741331 | N/A | N/A | 74295 | 74311 | ATAGAACTCTGTAGTCA | 42 | 398 |
| 741332 | N/A | N/A | 74296 | 74312 | AATAGAACTCTGTAGTC | 42 | 1338 |
| 741333 | N/A | N/A | 74298 | 74314 | TGAATAGAACTCTGTAG | 25 | 1339 |
| 741334 | N/A | N/A | 74440 | 74456 | ACACAGAGCACTTCTTA | 15 | 1340 |
| 741335 | N/A | N/A | 74665 | 74681 | GGAGTTACAGAGTTGCC | 64 | 1341 |
| 741336 | N/A | N/A | 74890 | 74906 | TATCAGTCTATTAAGAA | 11 | 1342 |
| 741337 | N/A | N/A | 75115 | 75131 | AAGTTTCTCAGAGCCTG | 24 | 1343 |
| 741338 | N/A | N/A | 75340 | 75356 | AATACAGAAGTCTATTC | 0 | 1344 |
| 741339 | N/A | N/A | 75573 | 75589 | CATTGAATAAAAATTTG | 0 | 1345 |
| 741340 | N/A | N/A | 75945 | 75961 | CAGGTATAAAATTTTTT | 2 | 1346 |
| 741341 | N/A | N/A | 76170 | 76186 | GGTGTTAATCACTTGAA | 18 | 1347 |
| 741342 | N/A | N/A | 76398 | 76414 | TCTTGAAGCTAGTTGGG | 39 | 1348 |
| 741343 | N/A | N/A | 76623 | 76639 | AGGGCAACTAACCAACA | 20 | 1349 |
| 741344 | N/A | N/A | 76848 | 76864 | GTGGATACTTAGTATCA | 13 | 1350 |
| 741345 | N/A | N/A | 77073 | 77089 | CTCTCTCAGTTGTAGGT | 19 | 1351 |
| 741346 | N/A | N/A | 77298 | 77314 | AAAGTATGCTGTGTTCT | 46 | 1352 |
| 741347 | N/A | N/A | 77523 | 77539 | GTACCCGGCACTTTTCC | 15 | 1353 |
| 741348 | N/A | N/A | 77663 | 77679 | TCTAGAAAAGCTCTCTT | 0 | 1354 |
| 741349 | N/A | N/A | 77665 | 77681 | ACTCTAGAAAGCTCTC | 13 | 1355 |
| 741350 | N/A | N/A | 77666 | 77682 | GACTCTAGAAAAGCTCT | 36 | 247 |
| 741351 | N/A | N/A | 77667 | 77683 | AGACTCTAGAAAAGCTC | 26 | 1356 |
| 741352 | N/A | N/A | 77748 | 77764 | TGGCACCCAGGAGTAAG | 8 | 1357 |
| 741353 | N/A | N/A | 77973 | 77989 | CATACACAAAATCCCCT | 28 | 1358 |
| 741354 | N/A | N/A | 78198 | 78214 | CACATGAAGCCAGGGAC | 19 | 1359 |
| 741355 | N/A | N/A | 78423 | 78439 | GCAGGCCCTAAACTGTG | 5 | 1360 |
| 741356 | N/A | N/A | 78648 | 78664 | AAATTTATCTATCATGC | 30 | 1361 |
| 741357 | N/A | N/A | 78873 | 78889 | GCTAAACACTTTATCAA | 22 | 1362 |
| 741358 | N/A | N/A | 79098 | 79114 | ACTTCATTCTTTCTGTT | 30 | 1363 |
| 741359 | N/A | N/A | 79323 | 79339 | CAATTAAAAGATTACTT | 0 | 1364 |
| 741360 | N/A | N/A | 79548 | 79564 | ACATTGTACAGTTAATT | 9 | 1365 |
| 741361 | N/A | N/A | 79773 | 79789 | TACAAACCTTACTATGC | 9 | 1366 |
| 741362 | N/A | N/A | 79998 | 80014 | AACAGACTTAAACAAAC | 40 | 1367 |
| 741363 | N/A | N/A | 80223 | 80239 | CTCAGACATCATGTTTT | 52 | 1368 |

TABLE 28-continued

Percent reduction of human SNCA mRNA with 4-9-4 MOE and cEt gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 741364 | N/A | N/A | 80448 | 80464 | AGGCACTCACAAACATT | 33 | 1369 |
| 741365 | N/A | N/A | 80673 | 80689 | TCTCGCATCCTAAATGT | 0 | 1370 |
| 741366 | N/A | N/A | 80898 | 80914 | TTCATATTTTATGTTAC | 23 | 1371 |
| 741367 | N/A | N/A | 80991 | 81007 | TGAAATTTTCCAGCTAA | 52 | 1372 |
| 741368 | N/A | N/A | 80993 | 81009 | CTTGAAATTTTCCAGCT | 72 | 1373 |
| 741369 | N/A | N/A | 80995 | 81011 | ATCTTGAAATTTTCCAG | 33 | 1374 |
| 741370 | N/A | N/A | 81123 | 81139 | CTATAATTACATTCCTA | 9 | 1375 |
| 741371 | N/A | N/A | 81348 | 81364 | GCATGAACCTAGATATG | 4 | 1376 |
| 741372 | N/A | N/A | 81472 | 81488 | GCTGTTTGAAGTGACAA | 21 | 1377 |
| 741373 | N/A | N/A | 81474 | 81490 | GAGCTGTTTGAAGTGAC | 54 | 1378 |
| 741374 | N/A | N/A | 81475 | 81491 | AGAGCTGTTTGAAGTGA | 52 | 249 |
| 741375 | N/A | N/A | 81476 | 81492 | GAGAGCTGTTTGAAGTG | 22 | 1379 |
| 741376 | N/A | N/A | 81478 | 81494 | TGGAGAGCTGTTTGAAG | 12 | 1380 |
| 741377 | N/A | N/A | 81575 | 81591 | CTGCCACTATTCACAAT | 27 | 1381 |
| 741378 | N/A | N/A | 81800 | 81816 | TTATTGCATTAATGGAA | 76 | 1382 |
| 741379 | N/A | N/A | 82107 | 82123 | ATGGTGTTAGCTAGGAT | 84 | 1383 |
| 741380 | N/A | N/A | 82332 | 82348 | GTCTTTTTACATTATAA | 31 | 1384 |
| 741381 | N/A | N/A | 82557 | 82573 | ATAACCACTATTCAATG | 2 | 1385 |
| 741382 | N/A | N/A | 82783 | 82799 | AAAAATCACATTTGGCA | 48 | 1386 |
| 741383 | N/A | N/A | 83008 | 83024 | TTCTTTCACCTTATGAG | 21 | 1387 |
| 741384 | N/A | N/A | 83233 | 83249 | ATATATGTGTCAGTTCT | 22 | 1388 |
| 741385 | N/A | N/A | 83458 | 83474 | GTGTCACTTTTTAAGGT | 18 | 1389 |
| 741386 | N/A | N/A | 83528 | 83544 | AGAACAATGTCATCTTT | 43 | 1390 |
| 741387 | N/A | N/A | 83530 | 83546 | AAAGAACAATGTCATCT | 42 | 1391 |
| 741388 | N/A | N/A | 83531 | 83547 | GAAAGAACAATGTCATC | 25 | 98 |
| 741389 | N/A | N/A | 83532 | 83548 | GGAAAGAACAATGTCAT | 27 | 1392 |
| 741390 | N/A | N/A | 83534 | 83550 | CAGGAAAGAACAATGTC | 47 | 1393 |
| 741391 | N/A | N/A | 83683 | 83699 | CACAGGTATACACACTT | 42 | 1394 |
| 741392 | N/A | N/A | 83908 | 83924 | GTACAAAATCTGCATAT | 3 | 1395 |
| 741393 | N/A | N/A | 84133 | 84149 | ATAGGTATTTTATGCAT | 58 | 1396 |
| 741394 | N/A | N/A | 84616 | 84632 | CAAATTATGCATTTGTT | 0 | 1397 |

Example 5: Effect of 5-10-5 MOE Gapmers with Mixed Internucleoside Linkages on Human SNCA In Vitro, Single Dose Modified oligonucleotides complementary to a human SNCA nucleic acid were designed and tested for their effect on SNCA mRNA in vitro. The modified oligonucleotides were tested in a series of experiments that had similar culture conditions.

Cultured SH-SY5Y cells at a density of 20,000 cells per well were transfected using electroporation with 4,000 nM concentration of modified oligonucleotide or no modified oligonucleotide for untreated controls. After approximately 24 hours, RNA was isolated from the cells and SNCA mRNA levels were measured by quantitative real-time PCR using human primer probe set RTS2621 as described in Example 1. SNCA mRNA levels were adjusted according to total RNA content, as measured by RIBOGREEN®. Results are presented in the tables below as percent reduction of the amount of SNCA mRNA, relative to untreated control cells.

The modified oligonucleotides in tables 29-44 are 5-10-5 MOE gapmers. The gapmers are 20 nucleobases in length, wherein the central gap segment comprises ten 2'-deoxynucleosides and is flanked by wing segments on both the 5' end on the 3' end, each comprising five 2'-MOE nucleosides. The sugar motif for the gapmers is (from 5' to 3'): eeeeedddddddddeeeee; wherein 'd' represents a 2'-deoxyribose sugar and 'e' represents a 2'-MOE modified sugar. All cytosine residues throughout each gapmer are 5-methyl cytosines. The internucleoside linkages are mixed phosphodiester and phosphorothioate linkages. The internucleoside linkage motif for the gapmers is (from 5' to 3'): sooosssssssssssooss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the Tables below is complementary to human SNCA nucleic acid sequences SEQ ID NO: 1 or SEQ ID NO:2, as indicated. 'N/A' indicates that the modified oligonucleotide is not complementary to that particular nucleic acid with 100% complementarity. A value of 0% reduction indicates that the compound had no effect or increased mRNA concentrations in the cell. As shown below, modified oligonucleotides complementary to human SNCA reduced the amount of human SNCA mRNA.

TABLE 29

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 693413 | 19 | 38 | 4687 | 4706 | AATTCCTTTACACCACACTG | 53 | 28 |
| 693416 | 39 | 58 | 4707 | 4726 | GAATACATCCATGGCTAATG | 38 | 29 |
| 740410 | 240 | 256 | 4691 | 4707 | GAATTCCTTTACACCAC | 72 | 33 |
| 741410 | N/A | N/A | 87946 | 87962 | GTAAGTTGTGACCATGC | 64 | 402 |
| 762833 | 233 | 252 | N/A | N/A | TCCTTTACACCACACTGTCG | 50 | 1635 |
| 762834 | 234 | 253 | N/A | N/A | TTCCTTTACACCACACTGTC | 49 | 1636 |
| 762835 | 235 | 254 | N/A | N/A | ATTCCTTTACACCACACTGT | 39 | 1637 |
| 762836 | 237 | 256 | 4688 | 4707 | GAATTCCTTTACACCACACT | 50 | 1638 |
| 762837 | 238 | 257 | 4689 | 4708 | TGAATTCCTTTACACCACAC | 45 | 1639 |
| 762838 | 239 | 258 | 4690 | 4709 | ATGAATTCCTTTACACCACA | 47 | 1640 |
| 762839 | 240 | 259 | 4691 | 4710 | AATGAATTCCTTTACACCAC | 51 | 1641 |
| 762840 | 241 | 260 | 4692 | 4711 | TAATGAATTCCTTTACACCA | 41 | 1642 |
| 762841 | 242 | 261 | 4693 | 4712 | CTAATGAATTCCTTTACACC | 44 | 1643 |
| 762842 | 243 | 262 | 4694 | 4713 | GCTAATGAATTCCTTTACAC | 51 | 1644 |
| 762843 | 244 | 263 | 4695 | 4714 | GGCTAATGAATTCCTTTACA | 50 | 1645 |
| 762844 | 252 | 271 | 4703 | 4722 | ACATCCATGGCTAATGAATT | 45 | 1646 |
| 762845 | 253 | 272 | 4704 | 4723 | TACATCCATGGCTAATGAAT | 32 | 1647 |
| 762846 | 254 | 273 | 4705 | 4724 | ATACATCCATGGCTAATGAA | 34 | 1648 |
| 762847 | 255 | 274 | 4706 | 4725 | AATACATCCATGGCTAATGA | 32 | 1649 |
| 762848 | 257 | 276 | 4708 | 4727 | TGAATACATCCATGGCTAAT | 47 | 1650 |
| 762849 | 258 | 277 | 4709 | 4728 | ATGAATACATCCATGGCTAA | 43 | 1651 |

TABLE 29-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 762850 | 259 | 278 | 4710 | 4729 | CATGAATACATCCATGGCTA | 41 | 1652 |
| 762851 | 260 | 279 | 4711 | 4730 | TCATGAATACATCCATGGCT | 61 | 1653 |
| 762852 | 261 | 280 | 4712 | 4731 | TTCATGAATACATCCATGGC | 48 | 1654 |
| 762853 | 262 | 281 | 4713 | 4732 | TTTCATGAATACATCCATGG | 42 | 1655 |
| 762854 | 263 | 282 | 4714 | 4733 | CTTTCATGAATACATCCATG | 56 | 1656 |
| 762855 | 265 | 284 | 4716 | 4735 | TCCTTTCATGAATACATCCA | 61 | 1657 |
| 762856 | 49 | 68 | 4717 | 4736 | GTCCTTTCATGAATACATCC | 52 | 1658 |
| 762857 | 267 | 286 | 4718 | 4737 | AGTCCTTTCATGAATACATC | 38 | 1659 |
| 762858 | 268 | 287 | 4719 | 4738 | AAGTCCTTTCATGAATACAT | 60 | 1660 |
| 762859 | 269 | 288 | 4720 | 4739 | AAAGTCCTTTCATGAATACA | 51 | 1661 |
| 762860 | 270 | 289 | 4721 | 4740 | GAAAGTCCTTTCATGAATAC | 55 | 1662 |
| 762861 | 271 | 290 | 4722 | 4741 | TGAAAGTCCTTTCATGAATA | 44 | 1663 |
| 762862 | 272 | 291 | 4723 | 4742 | TTGAAAGTCCTTTCATGAAT | 34 | 1664 |
| 762863 | 56 | 75 | 4724 | 4743 | TTTGAAAGTCCTTTCATGAA | 28 | 1665 |
| 762864 | 432 | 451 | 17999 | 18018 | ACTTGCTCTTTGGTCTTCTC | 36 | 1666 |
| 762865 | 433 | 452 | 18000 | 18019 | CACTTGCTCTTTGGTCTTCT | 36 | 1667 |
| 762866 | 434 | 453 | 18001 | 18020 | TCACTTGCTCTTTGGTCTTC | 40 | 1668 |
| 762867 | 435 | 454 | 18002 | 18021 | GTCACTTGCTCTTTGGTCTT | 50 | 1669 |
| 762868 | 436 | 455 | 18003 | 18022 | TGTCACTTGCTCTTTGGTCT | 45 | 1670 |
| 762869 | 437 | 456 | 18004 | 18023 | TTGTCACTTGCTCTTTGGTC | 36 | 1671 |
| 762870 | 438 | 457 | 18005 | 18024 | TTTGTCACTTGCTCTTTGGT | 28 | 1672 |
| 762871 | 439 | 458 | 18006 | 18025 | ATTTGTCACTTGCTCTTTGG | 34 | 1673 |
| 762872 | 440 | 459 | 18007 | 18026 | CATTTGTCACTTGCTCTTTG | 41 | 1674 |
| 762873 | 441 | 460 | 18008 | 18027 | ACATTTGTCACTTGCTCTTT | 7 | 1675 |
| 762874 | 442 | 461 | 18009 | 18028 | AACATTTGTCACTTGCTCTT | 22 | 1676 |
| 762875 | N/A | N/A | 4681 | 4700 | TTTACACCACACTGGAAAAC | 13 | 1677 |
| 762876 | N/A | N/A | 4682 | 4701 | CTTTACACCACACTGGAAAA | 22 | 1678 |
| 762877 | N/A | N/A | 4683 | 4702 | CCTTTACACCACACTGGAAA | 44 | 1679 |
| 762878 | N/A | N/A | 4684 | 4703 | TCCTTTACACCACACTGGAA | 44 | 1680 |
| 762879 | N/A | N/A | 4685 | 4704 | TTCCTTTACACCACACTGGA | 45 | 1681 |
| 762880 | N/A | N/A | 4686 | 4705 | ATTCCTTTACACCACACTGG | 59 | 1682 |
| 762881 | N/A | N/A | 18150 | 18169 | TATAAATGTAACACAAAACG | 0 | 1683 |
| 762882 | N/A | N/A | 18255 | 18274 | GTAGCACTTTTTCACAAGGG | 67 | 1684 |
| 762883 | N/A | N/A | 18349 | 18368 | CTTTCTTCCAGAAATTGAAA | 49 | 1685 |
| 762884 | N/A | N/A | 18442 | 18461 | AAATTCCAAGACTTACAATT | 28 | 1686 |
| 762885 | N/A | N/A | 18535 | 18554 | AGAGATGATGTCACTATAAA | 50 | 1687 |

TABLE 29-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 762886 | N/A | N/A | 18628 | 18647 | TCTCTGGTTGGTATGTATTT | 62 | 1688 |
| 762887 | N/A | N/A | 18721 | 18740 | TATCTTTGGTATAATCTTAT | 41 | 1689 |
| 762888 | N/A | N/A | 18814 | 18833 | TTATTTTGCTGTTGTAGTGG | 35 | 1690 |
| 762889 | N/A | N/A | 18907 | 18926 | GGCAGGCCTCCCCAAGAACG | 35 | 1691 |
| 762890 | N/A | N/A | 19176 | 19195 | GGCAAAGAAAGGAAAAAGAA | 5 | 1692 |
| 762891 | N/A | N/A | 19269 | 19288 | ATGGTGCCTACATTCTAGAA | 69 | 1693 |
| 762892 | N/A | N/A | 19368 | 19387 | CTTAATTTAATAAATGTTTG | 7 | 1694 |
| 762893 | N/A | N/A | 19461 | 19480 | TTGGATAGCTGAATAGCACT | 58 | 1695 |
| 762894 | N/A | N/A | 19556 | 19575 | TGAAGTGGAAACAACCCAGA | 46 | 1696 |
| 762895 | N/A | N/A | 19627 | 19646 | ATTTTGTTCTGCCTTTTTA | 39 | 1697 |
| 762896 | N/A | N/A | 19628 | 19647 | TATTTTGTTCTGCCTTTTT | 49 | 1698 |
| 762897 | N/A | N/A | 19629 | 19648 | ATATTTTGTTCTGCCTTTT | 34 | 1699 |
| 762898 | N/A | N/A | 19630 | 19649 | GATATTTTGTTCTGCCTTT | 57 | 1700 |
| 762899 | N/A | N/A | 19631 | 19650 | AGATATTTTGTTCTGCCTT | 60 | 1701 |
| 762900 | N/A | N/A | 19632 | 19651 | CAGATATTTTGTTCTGCCT | 74 | 1702 |
| 762901 | N/A | N/A | 19633 | 19652 | ACAGATATTTTGTTCTGCC | 70 | 1703 |
| 762902 | N/A | N/A | 19634 | 19653 | CACAGATATTTTGTTCTGC | 48 | 1704 |
| 762903 | N/A | N/A | 19635 | 19654 | TCACAGATATTTTGTTCTG | 58 | 1705 |
| 762904 | N/A | N/A | 19636 | 19655 | ATCACAGATATTTTGTTCT | 55 | 1706 |
| 762905 | N/A | N/A | 19637 | 19656 | TATCACAGATATTTTGTTC | 56 | 1707 |
| 762906 | N/A | N/A | 19649 | 19668 | TAAATCTAAATATATCACAG | 15 | 1708 |
| 762907 | N/A | N/A | 19742 | 19761 | AACATTAGCTGAAGAACTTC | 36 | 1709 |
| 762908 | N/A | N/A | 19835 | 19854 | AACCAGGAATTAATATAATT | 33 | 1710 |

TABLE 30

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 60 | 33 |
| 741410 | N/A | N/A | 87946 | 87962 | GTAAGTTGTGACCATGC | 72 | 402 |
| 762837 | 238 | 257 | 4689 | 4708 | TGAATTCCTTTACACCACAC | 49 | 1639 |
| 762909 | N/A | N/A | 19928 | 19947 | CTGATTAATTGCCTGTGTAC | 48 | 1711 |
| 762910 | N/A | N/A | 20026 | 20045 | ATTAAGCTCTTTGATGTGCG | 65 | 1712 |
| 762911 | N/A | N/A | 20119 | 20138 | TCTTGGACTACCCACTTCCT | 45 | 1713 |
| 762912 | N/A | N/A | 20212 | 20231 | AAGGAAGGTAAGTTTTGAGG | 0 | 1714 |
| 762913 | N/A | N/A | 20305 | 20324 | AGACGGTACATGTTTCCCTG | 47 | 1715 |

TABLE 30-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 762914 | N/A | N/A | 20332 | 20351 | TGTATGCCTTAAATGCAGGT | 69 | 1716 |
| 762915 | N/A | N/A | 20398 | 20417 | TGGGTGGAAAGCAAACCCAG | 16 | 1717 |
| 762916 | N/A | N/A | 20491 | 20510 | CTACCTATAAGGGAAATATC | 20 | 1718 |
| 762917 | N/A | N/A | 20584 | 20603 | TCACTCTCAGTCCAATGTTT | 55 | 1719 |
| 762918 | N/A | N/A | 20677 | 20696 | GAGCTTCCTCATTTTATGAG | 41 | 1720 |
| 762919 | N/A | N/A | 20770 | 20789 | ACCACAATTGCAGACATTTA | 41 | 1721 |
| 762920 | N/A | N/A | 20871 | 20890 | TCAAAGTTTAAAAAATGAAA | 6 | 1722 |
| 762921 | N/A | N/A | 20964 | 20983 | TCTTGAATGATGAATGAGTG | 59 | 1723 |
| 762922 | N/A | N/A | 20979 | 20998 | TGAGCAAACATTCTTTCTTG | 59 | 1724 |
| 762923 | N/A | N/A | 20980 | 20999 | GTGAGCAAACATTCTTTCTT | 62 | 1725 |
| 762924 | N/A | N/A | 20981 | 21000 | TGTGAGCAAACATTCTTTCT | 74 | 1726 |
| 762925 | N/A | N/A | 20982 | 21001 | GTGTGAGCAAACATTCTTTC | 52 | 1727 |
| 762926 | N/A | N/A | 20983 | 21002 | AGTGTGAGCAAACATTCTTT | 75 | 1728 |
| 762927 | N/A | N/A | 20984 | 21003 | CAGTGTGAGCAAACATTCTT | 50 | 1729 |
| 762928 | N/A | N/A | 20985 | 21004 | ACAGTGTGAGCAAACATTCT | 57 | 1730 |
| 762929 | N/A | N/A | 20986 | 21005 | CACAGTGTGAGCAAACATTC | 63 | 1731 |
| 762929 | N/A | N/A | 27411 | 27430 | CACAGTGTGAGCAAACATTC | 63 | 1731 |
| 762930 | N/A | N/A | 20987 | 21006 | GCACAGTGTGAGCAAACATT | 75 | 1732 |
| 762931 | N/A | N/A | 20988 | 21007 | GGCACAGTGTGAGCAAACAT | 51 | 1733 |
| 762932 | N/A | N/A | 20989 | 21008 | TGGCACAGTGTGAGCAAACA | 72 | 1734 |
| 762933 | N/A | N/A | 20993 | 21012 | TTTCTGGCACAGTGTGAGCA | 43 | 1735 |
| 762934 | N/A | N/A | 20994 | 21013 | GTTTCTGGCACAGTGTGAGC | 59 | 1736 |
| 762935 | N/A | N/A | 20995 | 21014 | AGTTTCTGGCACAGTGTGAG | 53 | 1737 |
| 762936 | N/A | N/A | 20996 | 21015 | AAGTTTCTGGCACAGTGTGA | 44 | 1738 |
| 762937 | N/A | N/A | 20997 | 21016 | CAAGTTTCTGGCACAGTGTG | 50 | 1739 |
| 762938 | N/A | N/A | 20998 | 21017 | CCAAGTTTCTGGCACAGTGT | 42 | 1740 |
| 762939 | N/A | N/A | 20999 | 21018 | TCCAAGTTTCTGGCACAGTG | 51 | 1741 |
| 762940 | N/A | N/A | 21000 | 21019 | CTCCAAGTTTCTGGCACAGT | 40 | 1742 |
| 762941 | N/A | N/A | 21001 | 21020 | CCTCCAAGTTTCTGGCACAG | 51 | 1743 |
| 762942 | N/A | N/A | 21002 | 21021 | TCCTCCAAGTTTCTGGCACA | 57 | 1744 |
| 762943 | N/A | N/A | 21003 | 21022 | TTCCTCCAAGTTTCTGGCAC | 32 | 1745 |
| 762944 | N/A | N/A | 21057 | 21076 | ATTAATCCACTTCTACAAGC | 30 | 1746 |
| 762945 | N/A | N/A | 21150 | 21169 | GAGGGTGATGGACCAGATAC | 51 | 1747 |
| 762946 | N/A | N/A | 21218 | 21237 | CAGAATTATGTCATTTAATT | 40 | 1748 |
| 762947 | N/A | N/A | 21219 | 21238 | TCAGAATTATGTCATTTAAT | 58 | 1749 |
| 762948 | N/A | N/A | 21220 | 21239 | TTCAGAATTATGTCATTTAA | 59 | 1750 |

TABLE 30-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 762949 | N/A | N/A | 21221 | 21240 | GTTCAGAATTATGTCATTTA | 56 | 1751 |
| 762950 | N/A | N/A | 21222 | 21241 | TGTTCAGAATTATGTCATTT | 66 | 1752 |
| 762951 | N/A | N/A | 21223 | 21242 | TTGTTCAGAATTATGTCATT | 61 | 1753 |
| 762952 | N/A | N/A | 21224 | 21243 | GTTGTTCAGAATTATGTCAT | 68 | 1754 |
| 762953 | N/A | N/A | 21225 | 21244 | GGTTGTTCAGAATTATGTCA | 75 | 1755 |
| 762954 | N/A | N/A | 21226 | 21245 | TGGTTGTTCAGAATTATGTC | 51 | 1756 |
| 762955 | N/A | N/A | 21227 | 21246 | TTGGTTGTTCAGAATTATGT | 67 | 1757 |
| 762956 | N/A | N/A | 21228 | 21247 | ATTGGTTGTTCAGAATTATG | 57 | 1758 |
| 762957 | N/A | N/A | 21243 | 21262 | ATTTACTCTCGATTTATTGG | 65 | 1759 |
| 762958 | N/A | N/A | 21336 | 21355 | TCATTTGTCCTTTAACTAGT | 55 | 1760 |
| 762959 | N/A | N/A | 21429 | 21448 | TAAAAATATGGATCAAAAGA | 0 | 1761 |
| 762960 | N/A | N/A | 21522 | 21541 | TGTGCACTTTTAACCTGTTT | 69 | 1762 |
| 762961 | N/A | N/A | 21616 | 21635 | TTAGAACAAGCAGATCTTTC | 63 | 1763 |
| 762962 | N/A | N/A | 21709 | 21728 | ATAGACCAAGTGTTCTAGTG | 68 | 1764 |
| 762963 | N/A | N/A | 21802 | 21821 | GAGCATTCCATGTGGCATGA | 62 | 1765 |
| 762964 | N/A | N/A | 21895 | 21914 | CAGGCAGTGGCTTCACAGTT | 40 | 1766 |
| 762965 | N/A | N/A | 21993 | 22012 | TTTCAAGCTTATTTCTTGCG | 69 | 1767 |
| 762966 | N/A | N/A | 22086 | 22105 | AAATGGCATTGCTTAGGAAC | 39 | 1768 |
| 762967 | N/A | N/A | 22179 | 22198 | AAGTCAGGATTATTACAGAA | 51 | 1769 |
| 762968 | N/A | N/A | 22273 | 22292 | GATATTATATTCACAATGTC | 34 | 1770 |
| 762969 | N/A | N/A | 22366 | 22385 | GGTCCATAACACTCAAGTGT | 79 | 1771 |
| 762970 | N/A | N/A | 22448 | 22467 | GACCTGTGCTTGTTTGTGAA | 60 | 1772 |
| 762971 | N/A | N/A | 22449 | 22468 | TGACCTGTGCTTGTTTGTGA | 58 | 1773 |
| 762972 | N/A | N/A | 22450 | 22469 | GTGACCTGTGCTTGTTTGTG | 56 | 1774 |
| 762973 | N/A | N/A | 22451 | 22470 | TGTGACCTGTGCTTGTTTGT | 48 | 1775 |
| 762974 | N/A | N/A | 22452 | 22471 | CTGTGACCTGTGCTTGTTTG | 61 | 1776 |
| 762975 | N/A | N/A | 22453 | 22472 | CCTGTGACCTGTGCTTGTTT | 47 | 1777 |
| 762976 | N/A | N/A | 22454 | 22473 | GCCTGTGACCTGTGCTTGTT | 50 | 1778 |
| 762977 | N/A | N/A | 22455 | 22474 | TGCCTGTGACCTGTGCTTGT | 54 | 1779 |
| 762978 | N/A | N/A | 22456 | 22475 | TTGCCTGTGACCTGTGCTTG | 59 | 1780 |
| 762979 | N/A | N/A | 22457 | 22476 | GTTGCCTGTGACCTGTGCTT | 68 | 1781 |
| 762980 | N/A | N/A | 22458 | 22477 | TGTTGCCTGTGACCTGTGCT | 54 | 1782 |
| 762981 | N/A | N/A | 22459 | 22478 | ATGTTGCCTGTGACCTGTGC | 40 | 1783 |
| 762982 | N/A | N/A | 22460 | 22479 | AATGTTGCCTGTGACCTGTG | 28 | 1784 |

TABLE 30-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 762983 | N/A | N/A | 22461 | 22480 | AAATGTTGCCTGTGACCTGT | 49 | 1785 |
| 762984 | N/A | N/A | 22462 | 22481 | GAAATGTTGCCTGTGACCTG | 30 | 1786 |
| 762985 | N/A | N/A | 22463 | 22482 | TGAAATGTTGCCTGTGACCT | 49 | 1787 |

TABLE 31

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 83 | 33 |
| 741410 | N/A | N/A | 87946 | 87962 | GTAAGTTGTGACCATGC | 94 | 402 |
| 762837 | 238 | 257 | 4689 | 4708 | TGAATTCCTTTACACCACAC | 52 | 1639 |
| 762986 | N/A | N/A | 22464 | 22483 | CTGAAATGTTGCCTGTGACC | 58 | 1788 |
| 762987 | N/A | N/A | 22552 | 22571 | CTCCAGTCCTGACATCTCTT | 77 | 1789 |
| 762988 | N/A | N/A | 22645 | 22664 | ACAAGAACCAAACTTTTAAT | 57 | 1790 |
| 762989 | N/A | N/A | 22738 | 22757 | CAAATCAGGCAATTCATTGT | 57 | 1791 |
| 762990 | N/A | N/A | 22831 | 22850 | AAATCAATCTTAAATTTTTC | 0 | 1792 |
| 762991 | N/A | N/A | 22924 | 22943 | TTTATGTACCATTAGTGGGC | 63 | 1793 |
| 762992 | N/A | N/A | 23017 | 23036 | CATTAGAATTCACTATTCAT | 54 | 1794 |
| 762993 | N/A | N/A | 23110 | 23129 | TTAATGAAAACATAGCAGTA | 37 | 1795 |
| 762994 | N/A | N/A | 23203 | 23222 | AAGGCAGGAGCCACCCATAT | 56 | 1796 |
| 762995 | N/A | N/A | 23279 | 23298 | TTCTCAGAGACCACAGCTGC | 70 | 1797 |
| 762996 | N/A | N/A | 23280 | 23299 | GTTCTCAGAGACCACAGCTG | 70 | 1798 |
| 762997 | N/A | N/A | 23281 | 23300 | TGTTCTCAGAGACCACAGCT | 64 | 1799 |
| 762998 | N/A | N/A | 23282 | 23301 | TTGTTCTCAGAGACCACAGC | 68 | 1800 |
| 762999 | N/A | N/A | 23283 | 23302 | ATTGTTCTCAGAGACCACAG | 67 | 1801 |
| 763000 | N/A | N/A | 23284 | 23303 | TATTGTTCTCAGAGACCACA | 57 | 1802 |
| 763001 | N/A | N/A | 23285 | 23304 | ATATTGTTCTCAGAGACCAC | 71 | 1803 |
| 763002 | N/A | N/A | 23286 | 23305 | CATATTGTTCTCAGAGACCA | 81 | 1804 |
| 763003 | N/A | N/A | 23287 | 23306 | CCATATTGTTCTCAGAGACC | 67 | 1805 |
| 763004 | N/A | N/A | 23288 | 23307 | ACCATATTGTTCTCAGAGAC | 69 | 1806 |
| 763005 | N/A | N/A | 23289 | 23308 | AACCATATTGTTCTCAGAGA | 65 | 1807 |
| 763006 | N/A | N/A | 23290 | 23309 | AAACCATATTGTTCTCAGAG | 68 | 1808 |
| 763007 | N/A | N/A | 23291 | 23310 | CAAACCATATTGTTCTCAGA | 64 | 1809 |
| 763008 | N/A | N/A | 23296 | 23315 | TGTAACAAACCATATTGTTC | 73 | 1810 |
| 763009 | N/A | N/A | 23389 | 23408 | CAAAAACACAATTTAATGTA | 14 | 1811 |
| 763010 | N/A | N/A | 23482 | 23501 | GATTTGGGTGGAAGTATTTG | 47 | 1812 |

TABLE 31-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763011 | N/A | N/A | 23575 | 23594 | CGCAATCAGTTCTTTGAATA | 73 | 1813 |
| 763012 | N/A | N/A | 23668 | 23687 | CAAATATGATTTAAACCTAT | 4 | 1814 |
| 763013 | N/A | N/A | 23761 | 23780 | ATGGGTTCACAGAAGTGTGG | 65 | 1815 |
| 763014 | N/A | N/A | 23854 | 23873 | ACAGTATCTCATTAATGAAA | 45 | 1816 |
| 763015 | N/A | N/A | 23948 | 23967 | ATAAGTATCTCAAAACATCA | 52 | 1817 |
| 763016 | N/A | N/A | 24041 | 24060 | AAGATAACCATATGATGATG | 42 | 1818 |
| 763017 | N/A | N/A | 24160 | 24179 | GTAAGATGAGTAAGTCTAAA | 59 | 1819 |
| 763018 | N/A | N/A | 24253 | 24272 | ACATATAAGTGCTATTTTTC | 42 | 1820 |
| 763019 | N/A | N/A | 24346 | 24365 | AGGGACAAACAGGTTGTTTA | 83 | 1821 |
| 763020 | N/A | N/A | 24439 | 24458 | AAAGCAAATAGCATCATCAA | 44 | 1822 |
| 763021 | N/A | N/A | 24539 | 24558 | CTGTACCCTTGAATATCACG | 69 | 1823 |
| 763022 | N/A | N/A | 24632 | 24651 | ACAATTAAATTGATGAGATG | 18 | 1824 |
| 763023 | N/A | N/A | 24731 | 24750 | CTTAAAAATCCAAATGTTGT | 51 | 1825 |
| 763024 | N/A | N/A | 24825 | 24844 | CATTAATAAGAATTAAATGC | 6 | 1826 |
| 763025 | N/A | N/A | 24850 | 24869 | TTCTTTGCATTAGTATTCAC | 53 | 1827 |
| 763026 | N/A | N/A | 24851 | 24870 | ATTCTTTGCATTAGTATTCA | 48 | 1828 |
| 763027 | N/A | N/A | 24852 | 24871 | TATTCTTTGCATTAGTATTC | 48 | 1829 |
| 763028 | N/A | N/A | 24853 | 24872 | GTATTCTTTGCATTAGTATT | 60 | 1830 |
| 763029 | N/A | N/A | 24854 | 24873 | AGTATTCTTTGCATTAGTAT | 72 | 1831 |
| 763030 | N/A | N/A | 24855 | 24874 | CAGTATTCTTTGCATTAGTA | 69 | 1832 |
| 763031 | N/A | N/A | 24856 | 24875 | TCAGTATTCTTTGCATTAGT | 70 | 1833 |
| 763032 | N/A | N/A | 24857 | 24876 | CTCAGTATTCTTTGCATTAG | 77 | 1834 |
| 763033 | N/A | N/A | 24858 | 24877 | GCTCAGTATTCTTTGCATTA | 79 | 1835 |
| 763034 | N/A | N/A | 24859 | 24878 | GGCTCAGTATTCTTTGCATT | 69 | 1836 |
| 763035 | N/A | N/A | 24860 | 24879 | TGGCTCAGTATTCTTTGCAT | 77 | 1837 |
| 763036 | N/A | N/A | 24918 | 24937 | TCCATTTTTTCACTTACTTG | 75 | 1838 |
| 763037 | N/A | N/A | 25011 | 25030 | TTAGATTTATCATATTGTTG | 50 | 1839 |
| 763038 | N/A | N/A | 25104 | 25123 | TTAAAATCTATTTGATTTCA | 32 | 1840 |
| 763039 | N/A | N/A | 25198 | 25217 | CCAAATAGAAAAAAGTGTG | 18 | 1841 |
| 763040 | N/A | N/A | 25291 | 25310 | CTGTATGTACAACCTCAGAA | 82 | 1842 |
| 763041 | N/A | N/A | 25384 | 25403 | CCTGACATAAGTAGGAAGCA | 63 | 1843 |
| 763042 | N/A | N/A | 25477 | 25496 | CCTACTTTAGATATGTCATA | 69 | 1844 |
| 763043 | N/A | N/A | 25570 | 25589 | TGTTAGTATACCTTTGTAGG | 72 | 1845 |
| 763044 | N/A | N/A | 25663 | 25682 | GAGGGCCAGCTGGCCATCAT | 15 | 1846 |
| 763045 | N/A | N/A | 25756 | 25775 | GAATTCAAGCCCATGCCCTC | 44 | 1847 |
| 763046 | N/A | N/A | 25854 | 25873 | CAACATTTTTATTTCACAGA | 54 | 1848 |

TABLE 31-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763047 | N/A | N/A | 25947 | 25966 | GTTGCCAGGGATCTGGCAAC | 15 | 1849 |
| 763048 | N/A | N/A | 26040 | 26059 | TGTCTGCATTATCTTATTTC | 67 | 1850 |
| 763049 | N/A | N/A | 26133 | 26152 | TGTGATCATGTATCGACACA | 78 | 1851 |
| 763050 | N/A | N/A | 26226 | 26245 | AACGGCATGTTCAGTGATGC | 82 | 1852 |
| 763051 | N/A | N/A | 26319 | 26338 | ATTATACCATGTGCATAATA | 54 | 1853 |
| 763052 | N/A | N/A | 26412 | 26431 | GCCTTTGAGATTTGCTTCAG | 91 | 1854 |
| 763053 | N/A | N/A | 26505 | 26524 | TTTTACTGAACACCTAGAAC | 54 | 1855 |
| 763054 | N/A | N/A | 26598 | 26617 | TTCATCTAGGACCTGCAATC | 39 | 1856 |
| 763055 | N/A | N/A | 26691 | 26710 | TTGGTGTTGTCCCAAGAAAT | 63 | 1857 |
| 763056 | N/A | N/A | 26784 | 26803 | CTGCAATCTACTTAGACCTG | 71 | 1858 |
| 763057 | N/A | N/A | 26877 | 26896 | AGGAAAAACTCTGCCCTCCT | 46 | 1859 |
| 763058 | N/A | N/A | 26978 | 26997 | CAAATGAACTTGGGAGGAGG | 14 | 1860 |
| 763059 | N/A | N/A | 27071 | 27090 | AGTGCAGGATGAAACCAGAC | 76 | 1861 |
| 763060 | N/A | N/A | 27164 | 27183 | TGAAGTATTAGAGAGGATCA | 46 | 1862 |
| 763061 | N/A | N/A | 27257 | 27276 | CTCGGACGGAAGTGAAGGCA | 57 | 1863 |
| 763062 | N/A | N/A | 27350 | 27369 | GCTCACTTCCTGTCACCCCC | 49 | 1864 |

TABLE 32

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 76 | 33 |
| 741410 | N/A | N/A | 87946 | 87962 | GTAAGTTGTGACCATGC | 64 | 402 |
| 762837 | 238 | 257 | 4689 | 4708 | TGAATTCCTTTACACCACAC | 61 | 1639 |
| 763063 | N/A | N/A | 27443 | 27462 | TAGGATGCAGCCTGAGGAGC | 29 | 1865 |
| 763064 | N/A | N/A | 27536 | 27555 | CATTAGAGTTTGTCTCTGGT | 58 | 1866 |
| 763065 | N/A | N/A | 27629 | 27648 | GACCCTTTCATTACCTTTCA | 81 | 1867 |
| 763066 | N/A | N/A | 27722 | 27741 | TCCTAGCCCACATCTTAGTA | 19 | 1868 |
| 763067 | N/A | N/A | 27815 | 27834 | ATTGTTCTGATTGATGGACA | 59 | 1869 |
| 763068 | N/A | N/A | 27908 | 27927 | TGCGACTGGTCAGAGCATGC | 63 | 1870 |
| 763069 | N/A | N/A | 28001 | 28020 | TCTAGCACTATTTTTTTCAA | 31 | 1871 |
| 763070 | N/A | N/A | 28094 | 28113 | TTAATAATTATTCTACAACA | 0 | 1872 |
| 763071 | N/A | N/A | 28192 | 28211 | CACATACAGGTTTTTAAAAA | 21 | 1873 |
| 763072 | N/A | N/A | 28231 | 28250 | CCTTGTGCATTTATTCCACG | 84 | 1874 |
| 763073 | N/A | N/A | 28232 | 28251 | ACCTTGTGCATTTATTCCAC | 67 | 1875 |
| 763074 | N/A | N/A | 28233 | 28252 | TACCTTGTGCATTTATTCCA | 64 | 1876 |

TABLE 32-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763075 | N/A | N/A | 28234 | 28253 | GTACCTTGTGCATTTATTCC | 70 | 1877 |
| 763076 | N/A | N/A | 28235 | 28254 | AGTACCTTGTGCATTTATTC | 68 | 1878 |
| 763077 | N/A | N/A | 28236 | 28255 | GAGTACCTTGTGCATTTATT | 67 | 1879 |
| 763078 | N/A | N/A | 28286 | 28305 | CGAAGAATTACCCAGCCCAA | 28 | 1880 |
| 763079 | N/A | N/A | 28379 | 28398 | GTGCTTGTTGCCATGCTGGG | 78 | 1881 |
| 763080 | N/A | N/A | 28451 | 28470 | TGTAATCTAGGACCCAGTAA | 56 | 1882 |
| 763081 | N/A | N/A | 28452 | 28471 | CTGTAATCTAGGACCCAGTA | 70 | 1883 |
| 763082 | N/A | N/A | 28453 | 28472 | ACTGTAATCTAGGACCCAGT | 63 | 1884 |
| 763083 | N/A | N/A | 28454 | 28473 | GACTGTAATCTAGGACCCAG | 69 | 1885 |
| 763084 | N/A | N/A | 28455 | 28474 | AGACTGTAATCTAGGACCCA | 72 | 1886 |
| 763085 | N/A | N/A | 28456 | 28475 | CAGACTGTAATCTAGGACCC | 70 | 1887 |
| 763086 | N/A | N/A | 28457 | 28476 | CCAGACTGTAATCTAGGACC | 64 | 1888 |
| 763087 | N/A | N/A | 28458 | 28477 | TCCAGACTGTAATCTAGGAC | 92 | 1889 |
| 763088 | N/A | N/A | 28459 | 28478 | ATCCAGACTGTAATCTAGGA | 83 | 1890 |
| 763089 | N/A | N/A | 28460 | 28479 | AATCCAGACTGTAATCTAGG | 51 | 1891 |
| 763090 | N/A | N/A | 28461 | 28480 | TAATCCAGACTGTAATCTAG | 49 | 1892 |
| 763091 | N/A | N/A | 28472 | 28491 | AAGGAACGCAATAATCCAGA | 47 | 1893 |
| 763092 | N/A | N/A | 28565 | 28584 | ACCAGTGCGGAATATTGTAA | 64 | 1894 |
| 763093 | N/A | N/A | 28669 | 28688 | ATCAGTCGAATGAATGTACG | 36 | 1895 |
| 763094 | N/A | N/A | 28765 | 28784 | CAGATGGATGGGTGGACAAA | 52 | 1896 |
| 763095 | N/A | N/A | 29117 | 29136 | TTGGCATTGTATTTTTTTTG | 60 | 1897 |
| 763096 | N/A | N/A | 29210 | 29229 | TAGACTCCTACACATATTAA | 32 | 1898 |
| 763097 | N/A | N/A | 29303 | 29322 | GATACTTCACTCAGAAAACC | 34 | 1899 |
| 763098 | N/A | N/A | 29396 | 29415 | AAAATGGTTTGATAGTTGGG | 55 | 1900 |
| 763099 | N/A | N/A | 29454 | 29473 | TTGTTAATAGTTCTCTGTTT | 62 | 1901 |
| 763100 | N/A | N/A | 29455 | 29474 | TTTGTTAATAGTTCTCTGTT | 45 | 1902 |
| 763101 | N/A | N/A | 29456 | 29475 | TTTTGTTAATAGTTCTCTGT | 54 | 1903 |
| 763102 | N/A | N/A | 29457 | 29476 | TTTTTGTTAATAGTTCTCTG | 70 | 1904 |
| 763103 | N/A | N/A | 29489 | 29508 | GGATACCATACAACCAATTA | 57 | 1905 |
| 763104 | N/A | N/A | 29582 | 29601 | ACAACTAAATCACTCAATTC | 8 | 1906 |
| 763105 | N/A | N/A | 29675 | 29694 | CAGAGCCCAAAACATTTATA | 33 | 1907 |
| 763106 | N/A | N/A | 29801 | 29820 | CAAATGCCTTGATCTTGGAG | 42 | 1908 |
| 763107 | N/A | N/A | 29894 | 29913 | GAGAACACAGCATTTGGCCC | 68 | 1909 |
| 763108 | N/A | N/A | 29997 | 30016 | AGAGGTAATAAAGTCACGGG | 46 | 1910 |
| 763109 | N/A | N/A | 30090 | 30109 | ATATGAAAATGAAAGGATGG | 28 | 1911 |
| 763110 | N/A | N/A | 30193 | 30212 | TTACAGTTTCCTATATATCG | 25 | 1912 |

TABLE 32-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763111 | N/A | N/A | 30287 | 30306 | TCATACACAAAATAAACACA | 33 | 1913 |
| 763112 | N/A | N/A | 30380 | 30399 | GAATAGCAGTATGTACTAAT | 40 | 1914 |
| 763113 | N/A | N/A | 30473 | 30492 | ACCTTTCAATAAACTGTTAA | 33 | 1915 |
| 763114 | N/A | N/A | 30566 | 30585 | ATTTTTTCATATATAGTGAG | 49 | 1916 |
| 763115 | N/A | N/A | 30659 | 30678 | CTGTAACAAATATACATTTT | 36 | 1917 |
| 763116 | N/A | N/A | 30752 | 30771 | ACCAATTAGTTTCTAATAAG | 38 | 1918 |
| 763117 | N/A | N/A | 30885 | 30904 | TTATATACACACACAGCTAC | 14 | 1919 |
| 763118 | N/A | N/A | 30978 | 30997 | CCAAAAATAGAGATCAATGT | 31 | 1920 |
| 763119 | N/A | N/A | 31078 | 31097 | AAACCACTGGCTAATTTTTT | 57 | 1921 |
| 763120 | N/A | N/A | 31171 | 31190 | TGAGAGCTATATGGCTGAAA | 47 | 1922 |
| 763121 | N/A | N/A | 31264 | 31283 | AAAAGCCTTCTTAGTGGTAA | 53 | 1923 |
| 763122 | N/A | N/A | 31357 | 31376 | ATTACTGTGTTTCAGCAGTT | 51 | 1924 |
| 763123 | N/A | N/A | 31450 | 31469 | TTAGATATAAAAGGTATGAA | 0 | 1925 |
| 763124 | N/A | N/A | 31543 | 31562 | CTAGCCTAGGGTGGTAACAG | 17 | 1926 |
| 763125 | N/A | N/A | 31636 | 31655 | TGCTCAAGAATGGACTAGGT | 57 | 1927 |
| 763126 | N/A | N/A | 31729 | 31748 | TGCATTTCATTCTATGTATG | 62 | 1928 |
| 763127 | N/A | N/A | 31822 | 31841 | AGTTGGAGGGTGGCATACAA | 25 | 1929 |
| 763128 | N/A | N/A | 31915 | 31934 | AACAAACAATTCATTTTCTA | 0 | 1930 |
| 763129 | N/A | N/A | 32011 | 32030 | GTCTTTTTAAAATTAAAATC | 0 | 1931 |
| 763130 | N/A | N/A | 32104 | 32123 | TATAATATACAAAATTACTA | 0 | 1932 |
| 763131 | N/A | N/A | 32197 | 32216 | CAATAAGTAGTGCTGTTATA | 51 | 1933 |
| 763132 | N/A | N/A | 32290 | 32309 | AGTAGTTTTTAAATCTTCAA | 51 | 1934 |
| 763133 | N/A | N/A | 32383 | 32402 | GTGGTTCTGCCCATCTGTCC | 64 | 1935 |
| 763134 | N/A | N/A | 32476 | 32495 | TGTTTTCAAGAGCGATCGGA | 58 | 1936 |
| 763135 | N/A | N/A | 32569 | 32588 | GAGTAAGTTTAGATATAAAA | 36 | 1937 |
| 763136 | N/A | N/A | 32662 | 32681 | GCATAAAAGGCAGAGGGAGG | 35 | 1938 |
| 763137 | N/A | N/A | 32755 | 32774 | GCAACCTTTCTCTCCCTCTC | 65 | 1939 |
| 763138 | N/A | N/A | 32848 | 32867 | CTGAAGAAATAAATAAAGAA | 0 | 1940 |
| 763139 | N/A | N/A | 32941 | 32960 | TCAATATTCAGAGATGACTA | 27 | 1941 |

TABLE 33

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No:2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 78 | 33 |
| 741410 | N/A | N/A | 87946 | 87962 | GTAAGTTGTGACCATGC | 72 | 402 |

TABLE 33-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No:2 stop | Sequence (5' to 3') | % Reduction | SEQ ID NO |
|---|---|---|---|---|---|---|---|
| 762837 | 238 | 257 | 4689 | 4708 | TGAATTCCTTTACACCACAC | 46 | 1639 |
| 763140 | N/A | N/A | 33034 | 33053 | CACACCCGAAATACCACCTG | 49 | 1942 |
| 763141 | N/A | N/A | 33127 | 33146 | TAAGCTAAAATGGTTTCAAC | 45 | 1943 |
| 763142 | N/A | N/A | 33220 | 33239 | GGCAAAATTTGCATTGGATG | 79 | 1944 |
| 763143 | N/A | N/A | 33313 | 33332 | TGAAAAAGCTATGACCCTC | 30 | 1945 |
| 763144 | N/A | N/A | 33406 | 33425 | TTACTTCTACTTTTGTGAGG | 46 | 1946 |
| 763145 | N/A | N/A | 33499 | 33518 | CCAACATTTTAAGGAAGGTA | 73 | 1947 |
| 763146 | N/A | N/A | 33592 | 33611 | GGTAGAGAACACTTAAGTGA | 67 | 1948 |
| 763147 | N/A | N/A | 33689 | 33708 | CAAATTTTAAAAGTTAACTT | 0 | 1949 |
| 763148 | N/A | N/A | 33785 | 33804 | AATTTCTACAAGAAAAATAT | 0 | 1950 |
| 763149 | N/A | N/A | 33878 | 33897 | CCAGAAAGAAACATTTAGAA | 39 | 1951 |
| 763150 | N/A | N/A | 33971 | 33990 | GTGTTAACTGGCAATTCCAT | 82 | 1952 |
| 763151 | N/A | N/A | 33981 | 34000 | GTTCAATGCTGTGTTAACTG | 74 | 1953 |
| 763152 | N/A | N/A | 33982 | 34001 | AGTTCAATGCTGTGTTAACT | 63 | 1954 |
| 763153 | N/A | N/A | 33983 | 34002 | AAGTTCAATGCTGTGTTAAC | 50 | 1955 |
| 763154 | N/A | N/A | 33984 | 34003 | AAAGTTCAATGCTGTGTTAA | 38 | 1956 |
| 763155 | N/A | N/A | 33985 | 34004 | AAAAGTTCAATGCTGTGTTA | 49 | 1957 |
| 763156 | N/A | N/A | 33986 | 34005 | AAAAAGTTCAATGCTGTGTT | 63 | 1958 |
| 763157 | N/A | N/A | 33987 | 34006 | GAAAAAGTTCAATGCTGTGT | 56 | 1959 |
| 763158 | N/A | N/A | 33988 | 34007 | AGAAAAAGTTCAATGCTGTG | 62 | 1960 |
| 763159 | N/A | N/A | 33989 | 34008 | AAGAAAAAGTTCAATGCTGT | 42 | 1961 |
| 763160 | N/A | N/A | 33990 | 34009 | CAAGAAAAAGTTCAATGCTG | 52 | 1962 |
| 763161 | N/A | N/A | 33991 | 34010 | ACAAGAAAAAGTTCAATGCT | 28 | 1963 |
| 763162 | N/A | N/A | 34064 | 34083 | TAATATCAGCCAAAGACATT | 34 | 1964 |
| 763163 | N/A | N/A | 34157 | 34176 | TTGAAAAAAGTATTGACTCT | 16 | 1965 |
| 763164 | N/A | N/A | 34250 | 34269 | CTGTTAAAATGCATTTCTAG | 64 | 1966 |
| 763165 | N/A | N/A | 34383 | 34402 | GTATCCCAGCACTGTTGGGA | 25 | 1967 |
| 763166 | N/A | N/A | 34476 | 34495 | CTGGTTGCTATCTAGGGATC | 82 | 1968 |
| 763167 | N/A | N/A | 34569 | 34588 | AATAGAACCTAATATAATTT | 0 | 1969 |
| 763168 | N/A | N/A | 34662 | 34681 | CTTCTATCCTAGAATTCATA | 40 | 1970 |
| 763169 | N/A | N/A | 34755 | 34774 | ATGGGAATGAGGTGTAAAAG | 56 | 1971 |
| 763170 | N/A | N/A | 34848 | 34867 | CAGTCTGATAAGGAGAACAA | 45 | 1972 |
| 763171 | N/A | N/A | 34941 | 34960 | GGATAGAATATCAAGATAAA | 38 | 1973 |
| 763172 | N/A | N/A | 35034 | 35053 | TCACAGTGTTCTTTTCTCTT | 71 | 1974 |
| 763173 | N/A | N/A | 35127 | 35146 | TTGTGCTAGAATATGAGATC | 0 | 1975 |
| 763174 | N/A | N/A | 35220 | 35239 | TCTAGAATTCAAGCCACACC | 41 | 1976 |

TABLE 33-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No:2 stop | Sequence (5' to 3') | % Reduction | SEQ ID NO |
|---|---|---|---|---|---|---|---|
| 763175 | N/A | N/A | 35313 | 35332 | AATAATGATAGTATTTTCCT | 15 | 1977 |
| 763176 | N/A | N/A | 35406 | 35425 | CCATCACACCTTGCAGATGT | 70 | 1978 |
| 763177 | N/A | N/A | 35499 | 35518 | ACTTCCTTTAGAGTATACGG | 79 | 1979 |
| 763178 | N/A | N/A | 35594 | 35613 | GCACTATATAAAATGTAACG | 68 | 1980 |
| 763179 | N/A | N/A | 35687 | 35706 | GTTGTAATAATAATATTGAC | 51 | 1981 |
| 763180 | N/A | N/A | 35780 | 35799 | CTGTGACTTTGGTCTATTTG | 34 | 1982 |
| 763181 | N/A | N/A | 35873 | 35892 | GGATTGTGTAATAGCCTTTA | 60 | 1983 |
| 763182 | N/A | N/A | 35966 | 35985 | TGACTATCAGTATCTGTTGA | 75 | 1984 |
| 763183 | N/A | N/A | 36059 | 36078 | AAGTTGACTTGTGACATACA | 45 | 1985 |
| 763184 | N/A | N/A | 36152 | 36171 | TTCTACCGAAGGAAATATGT | 27 | 1986 |
| 763185 | N/A | N/A | 36250 | 36269 | AGTCATTTTAATAAGTGTTT | 72 | 1987 |
| 763186 | N/A | N/A | 36360 | 36379 | ATCTTCCAAAGTTACTGTAC | 49 | 1988 |
| 763187 | N/A | N/A | 36453 | 36472 | ATTTCCCAGTCTCGGGAACT | 17 | 1989 |
| 763188 | N/A | N/A | 36625 | 36644 | GCTAATGGTTTTATGTGTTT | 73 | 1990 |
| 763189 | N/A | N/A | 36789 | 36808 | CATATGGTGATATGGTTAGG | 55 | 1991 |
| 763190 | N/A | N/A | 36933 | 36952 | TCATTCACCTATTGAGGAAC | 50 | 1992 |
| 763191 | N/A | N/A | 37026 | 37045 | CTAAGTTTTCTCCATGTGTT | 52 | 1993 |
| 763192 | N/A | N/A | 37135 | 37154 | GAGCCCCAGGCAATCACTGA | 0 | 1994 |
| 763193 | N/A | N/A | 37229 | 37248 | GGTCATGTATCCACCATGAC | 44 | 1995 |
| 763194 | N/A | N/A | 37322 | 37341 | AAATAACATTGATACCTTAT | 40 | 1996 |
| 763195 | N/A | N/A | 37415 | 37434 | ATTACAGTGCATTCCCATAT | 41 | 1997 |
| 763196 | N/A | N/A | 37523 | 37542 | GGGTCTTGACTTCCCAAAGT | 74 | 1998 |
| 763197 | N/A | N/A | 37649 | 37668 | TCTTTTATTTCTTCTGTTCT | 34 | 1999 |
| 763198 | N/A | N/A | 37785 | 37804 | CGCATCTGTCTTTCTTTTCT | 31 | 2000 |
| 763199 | N/A | N/A | 37878 | 37897 | GTAATCTCACCCTACTGCAA | 4 | 2001 |
| 763200 | N/A | N/A | 37971 | 37990 | TATCTAGACTGAGCTTTACA | 39 | 2002 |
| 763201 | N/A | N/A | 38064 | 38083 | CATTCACATATTTGGATTCT | 60 | 2003 |
| 763202 | N/A | N/A | 38157 | 38176 | TGAAACATTAACTGCTTTAT | 51 | 2004 |
| 763203 | N/A | N/A | 38250 | 38269 | ACAATGCTATGTGGAAGTTA | 44 | 2005 |
| 763204 | N/A | N/A | 38343 | 38362 | CCTCAGTGCTAGCGAAGGAC | 67 | 2006 |
| 763205 | N/A | N/A | 38436 | 38455 | AATTTACAATCTACACAGGC | 53 | 2007 |
| 763206 | N/A | N/A | 38529 | 38548 | TCAATTCTTGAGGCCAATTG | 27 | 2008 |
| 763207 | N/A | N/A | 38622 | 38641 | TCAGTATTTCATTGTCATAC | 89 | 2009 |
| 763208 | N/A | N/A | 38715 | 38734 | GTTAGTGGAATTGTAAAATA | 54 | 2010 |
| 763209 | N/A | N/A | 38808 | 38827 | CTAGTTATAAAAAACAAGAT | 34 | 2011 |
| 763210 | N/A | N/A | 38901 | 38920 | TTGGCCCCAATCATTGGAAT | 43 | 2012 |
| 763211 | N/A | N/A | 38910 | 38929 | TTCTCTGTATTGGCCCCAAT | 52 | 2013 |

TABLE 33-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No:2 stop | Sequence (5' to 3') | % Reduction | SEQ ID NO |
|---|---|---|---|---|---|---|---|
| 763212 | N/A | N/A | 38911 | 38930 | TTTCTCTGTATTGGCCCCAA | 59 | 2014 |
| 763213 | N/A | N/A | 38912 | 38931 | TTTTCTCTGTATTGGCCCCA | 51 | 2015 |
| 763214 | N/A | N/A | 38913 | 38932 | GTTTTCTCTGTATTGGCCCC | 60 | 2016 |
| 763215 | N/A | N/A | 38914 | 38933 | TGTTTTCTCTGTATTGGCCC | 70 | 2017 |
| 763216 | N/A | N/A | 38915 | 38934 | ATGTTTTCTCTGTATTGGCC | 74 | 2018 |

TABLE 34

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 67 | 33 |
| 741410 | N/A | N/A | 87946 | 87962 | GTAAGTTGTGACCATGC | 95 | 402 |
| 762837 | 238 | 257 | 4689 | 4708 | TGAATTCCTTTACACCACAC | 47 | 1639 |
| 763217 | N/A | N/A | 38916 | 38935 | GATGTTTTCTCTGTATTGGC | 54 | 2019 |
| 763218 | N/A | N/A | 38917 | 38936 | AGATGTTTTCTCTGTATTGG | 61 | 2020 |
| 763219 | N/A | N/A | 38918 | 38937 | GAGATGTTTTCTCTGTATTG | 61 | 2021 |
| 763220 | N/A | N/A | 38919 | 38938 | TGAGATGTTTTCTCTGTATT | 48 | 2022 |
| 763221 | N/A | N/A | 38920 | 38939 | TTGAGATGTTTTCTCTGTAT | 52 | 2023 |
| 763222 | N/A | N/A | 38994 | 39013 | TTTTCAGCAGGAGTTATAAT | 43 | 2024 |
| 763223 | N/A | N/A | 39087 | 39106 | TATTCCGTGTGTTTTTCCTA | 31 | 2025 |
| 763224 | N/A | N/A | 39180 | 39199 | TTTTCTGATAAATGGTAATC | 12 | 2026 |
| 763225 | N/A | N/A | 39273 | 39292 | CAGGTGGTATCAGTCCAAAG | 69 | 2027 |
| 763226 | N/A | N/A | 39366 | 39385 | CACCACAAAGAGGAAACAGG | 41 | 2028 |
| 763227 | N/A | N/A | 39459 | 39478 | AATGTTCCCTGGGAGCACAA | 58 | 2029 |
| 763228 | N/A | N/A | 39555 | 39574 | ATGTCCTGTGCATTGTAGAT | 64 | 2030 |
| 763229 | N/A | N/A | 39585 | 39604 | TTTTTTAACTGGATACTTTG | 27 | 2031 |
| 763230 | N/A | N/A | 39586 | 39605 | ATTTTTTAACTGGATACTTT | 26 | 2032 |
| 763231 | N/A | N/A | 39587 | 39606 | CATTTTTTAACTGGATACTT | 44 | 2033 |
| 763232 | N/A | N/A | 39588 | 39607 | ACATTTTTTAACTGGATACT | 48 | 2034 |
| 763233 | N/A | N/A | 39589 | 39608 | GACATTTTTTAACTGGATAC | 66 | 2035 |
| 763234 | N/A | N/A | 39590 | 39609 | TGACATTTTTTAACTGGATA | 55 | 2036 |
| 763235 | N/A | N/A | 39591 | 39610 | ATGACATTTTTTAACTGGAT | 51 | 2037 |
| 763236 | N/A | N/A | 39592 | 39611 | AATGACATTTTTTAACTGGA | 64 | 2038 |
| 763237 | N/A | N/A | 39593 | 39612 | TAATGACATTTTTTAACTGG | 38 | 2039 |
| 763238 | N/A | N/A | 39594 | 39613 | GTAATGACATTTTTTAACTG | 53 | 2040 |

TABLE 34-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763239 | N/A | N/A | 39595 | 39614 | AGTAATGACATTTTTAACT | 38 | 2041 |
| 763240 | N/A | N/A | 39648 | 39667 | GTGCCTGGAGAAGATGAATT | 44 | 2042 |
| 763241 | N/A | N/A | 39741 | 39760 | CTTTTCCTATTTGGTATTTG | 53 | 2043 |
| 763242 | N/A | N/A | 39834 | 39853 | TTGCTAAATATTACTCACTC | 40 | 2044 |
| 763243 | N/A | N/A | 39927 | 39946 | ACCAGACTGACTGTAATATG | 60 | 2045 |
| 763244 | N/A | N/A | 40020 | 40039 | AAGTGAAAGCATTAGAGGAT | 54 | 2046 |
| 763245 | N/A | N/A | 40113 | 40132 | TGGTGTGTGCAAACATGTAT | 27 | 2047 |
| 763246 | N/A | N/A | 40206 | 40225 | TTGTGAGAAAGTTTTTATGG | 17 | 2048 |
| 763247 | N/A | N/A | 40299 | 40318 | ATAAATAGTCATAAGACTAT | 5 | 2049 |
| 763248 | N/A | N/A | 40392 | 40411 | AGTGTGATATCTAAATAAAA | 11 | 2050 |
| 763249 | N/A | N/A | 40485 | 40504 | AATTCTGGTGCCAATGGTGA | 70 | 2051 |
| 763250 | N/A | N/A | 40578 | 40597 | ATCATCTTATGGCTAAATTT | 42 | 2052 |
| 763251 | N/A | N/A | 40671 | 40690 | ATCTAGGCATGAGTTGTGTC | 39 | 2053 |
| 763252 | N/A | N/A | 40775 | 40794 | CGTTTGAATGAAAAATGACG | 37 | 2054 |
| 763253 | N/A | N/A | 40868 | 40887 | ATTAGAACGAGGATGGAGAA | 32 | 2055 |
| 763254 | N/A | N/A | 40961 | 40980 | AGAGAATTCACATGATAGAT | 44 | 2056 |
| 763255 | N/A | N/A | 41054 | 41073 | TAAGAAAGAATTTTAGGCAT | 35 | 2057 |
| 763256 | N/A | N/A | 41147 | 41166 | GCAGGAGCAACACAGTGAAC | 40 | 2058 |
| 763257 | N/A | N/A | 41241 | 41260 | GATCAACAGGAAACATTTAT | 45 | 2059 |
| 763258 | N/A | N/A | 41334 | 41353 | TACCCCTATATCTCAACTCA | 43 | 2060 |
| 763259 | N/A | N/A | 41427 | 41446 | AATGTTATAGTTTCTACATG | 34 | 2061 |
| 763260 | N/A | N/A | 41521 | 41540 | CCAATTATGTAATTTTAAAT | 0 | 2062 |
| 763261 | N/A | N/A | 41619 | 41638 | TCTCATTCAAAACCATCCTG | 59 | 2063 |
| 763262 | N/A | N/A | 41740 | 41759 | TAATTGTCTTGAGCCATGCA | 48 | 2064 |
| 763263 | N/A | N/A | 41833 | 41852 | GCTTATAGTACACATTAACT | 56 | 2065 |
| 763264 | N/A | N/A | 41933 | 41952 | GCCCTCTCTCATTACCGTCG | 44 | 2066 |
| 763265 | N/A | N/A | 42026 | 42045 | AATACAAATTAGTTGAGTTA | 22 | 2067 |
| 763266 | N/A | N/A | 42119 | 42138 | ATACCACATACTCATTTTAA | 46 | 2068 |
| 763267 | N/A | N/A | 42212 | 42231 | TAGTTACATGTAGAATGCAT | 41 | 2069 |
| 763268 | N/A | N/A | 42305 | 42324 | TCTGGGATACAAGGTGTACC | 54 | 2070 |
| 763269 | N/A | N/A | 42398 | 42417 | CTTCATGGGAAGAAAAGCTA | 33 | 2071 |
| 763270 | N/A | N/A | 42491 | 42510 | ACAGAAGTACAGCATGTAAG | 51 | 2072 |
| 763271 | N/A | N/A | 42598 | 42617 | TATTAAGAGTAATGCTATCG | 48 | 2073 |
| 763272 | N/A | N/A | 42691 | 42710 | AGTAGTCCATTCCATTTTTG | 76 | 2074 |
| 763273 | N/A | N/A | 42785 | 42804 | ATTTGTCTTTTCTGGAATTA | 47 | 2075 |
| 763274 | N/A | N/A | 42878 | 42897 | AATTCTAACACCATCTTGGA | 22 | 2076 |
| 763275 | N/A | N/A | 42971 | 42990 | CTACATTGTGGTTTTTCCTT | 31 | 2077 |

TABLE 34-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763276 | N/A | N/A | 43064 | 43083 | GGAAGCCAAGACTTTCTTGT | 55 | 2078 |
| 763277 | N/A | N/A | 43157 | 43176 | GACTGGCCTCCAGCCAATGA | 45 | 2079 |
| 763278 | N/A | N/A | 43250 | 43269 | ACCTCTTGGATCTTTTCTCT | 41 | 2080 |
| 763279 | N/A | N/A | 43343 | 43362 | TTCCCCAATTTTCCTTTGTG | 37 | 2081 |
| 763280 | N/A | N/A | 43436 | 43455 | CACTCATTTTAAATGTACAT | 49 | 2082 |
| 763281 | N/A | N/A | 43529 | 43548 | GTCTTAGGTTTATGTTCATG | 73 | 2083 |
| 763282 | N/A | N/A | 43622 | 43641 | AATGTCACAAGACTTCATCT | 59 | 2084 |
| 763283 | N/A | N/A | 43715 | 43734 | CCCCTTGAAAATGTATGTTA | 47 | 2085 |
| 763284 | N/A | N/A | 43808 | 43827 | GACCTCTTAATGTTTCTTTG | 53 | 2086 |
| 763285 | N/A | N/A | 43901 | 43920 | AGATCAGATCATAATCAATA | 42 | 2087 |
| 763286 | N/A | N/A | 43994 | 44013 | ACTAGAACTGAGGGACAAGG | 13 | 2088 |
| 763287 | N/A | N/A | 44376 | 44395 | ATTTTGGGCTGGAAGCAGTG | 6 | 2089 |
| 763288 | N/A | N/A | 44469 | 44488 | GGCAGGAACAACTCTGTCAG | 62 | 2090 |
| 763289 | N/A | N/A | 44574 | 44593 | AGCACCAACCAACCAGAGGG | 51 | 2091 |
| 763290 | N/A | N/A | 44667 | 44686 | CCCTGTCAAATTTTAGAAAT | 25 | 2092 |
| 763291 | N/A | N/A | 44826 | 44845 | TTGGTCTAACTGTGTTGCCC | 65 | 2093 |
| 763292 | N/A | N/A | 45028 | 45047 | GAGGATTCACTAATTTTTTT | 43 | 2094 |
| 763293 | N/A | N/A | 45121 | 45140 | AAACAAAAGAGAAGCAACC | 40 | 2095 |

TABLE 35

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 62 | 33 |
| 741410 | N/A | N/A | 87946 | 87962 | GTAAGTTGTGACCATGC | 72 | 402 |
| 762837 | 238 | 257 | 4689 | 4708 | TGAATTCCTTTACACCACAC | 34 | 1639 |
| 763294 | N/A | N/A | 45214 | 45233 | GTCTCTAGTTTTCCTAAAAT | 53 | 2096 |
| 763295 | N/A | N/A | 45307 | 45326 | AGGATACTCAATCTCTTAAT | 63 | 2097 |
| 763296 | N/A | N/A | 45400 | 45419 | CGAATAGAAAAATTTAACTT | 0 | 2098 |
| 763297 | N/A | N/A | 45493 | 45512 | CTTCAATTAATATTCCAAGA | 54 | 2099 |
| 763298 | N/A | N/A | 45586 | 45605 | CACTGTGGATGAAGGTTACT | 47 | 2100 |
| 763299 | N/A | N/A | 45679 | 45698 | GGACTACTTGATGTCTAGAT | 68 | 2101 |
| 763300 | N/A | N/A | 45773 | 45792 | TTTAATAATACAGTATTATT | 0 | 2102 |
| 763301 | N/A | N/A | 45866 | 45885 | AACCTACAGAGAGTGGACTT | 34 | 2103 |
| 763302 | N/A | N/A | 45959 | 45978 | TTTATTTCCCACATAAAATT | 4 | 2104 |

TABLE 35-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763303 | N/A | N/A | 46052 | 46071 | TACTTAAGAGAAAAAATAGT | 0 | 2105 |
| 763304 | N/A | N/A | 46145 | 46164 | CCAAGTAAATAGTATTTTGG | 28 | 2106 |
| 763305 | N/A | N/A | 46155 | 46174 | TTCCATGAAGCCAAGTAAAT | 63 | 2107 |
| 763306 | N/A | N/A | 46156 | 46175 | TTTCCATGAAGCCAAGTAAA | 44 | 2108 |
| 763307 | N/A | N/A | 46157 | 46176 | ATTTCCATGAAGCCAAGTAA | 48 | 2109 |
| 763308 | N/A | N/A | 46158 | 46177 | GATTTCCATGAAGCCAAGTA | 50 | 2110 |
| 763309 | N/A | N/A | 46159 | 46178 | AGATTTCCATGAAGCCAAGT | 66 | 2111 |
| 763310 | N/A | N/A | 46160 | 46179 | GAGATTTCCATGAAGCCAAG | 50 | 2112 |
| 763311 | N/A | N/A | 46161 | 46180 | AGAGATTTCCATGAAGCCAA | 34 | 2113 |
| 763312 | N/A | N/A | 46162 | 46181 | GAGAGATTTCCATGAAGCCA | 65 | 2114 |
| 763313 | N/A | N/A | 46163 | 46182 | AGAGAGATTTCCATGAAGCC | 41 | 2115 |
| 763314 | N/A | N/A | 46164 | 46183 | GAGAGAGATTTCCATGAAGC | 61 | 2116 |
| 763315 | N/A | N/A | 46165 | 46184 | TGAGAGAGATTTCCATGAAG | 30 | 2117 |
| 763316 | N/A | N/A | 46166 | 46185 | GTGAGAGAGATTTCCATGAA | 47 | 2118 |
| 763317 | N/A | N/A | 46167 | 46186 | AGTGAGAGAGATTTCCATGA | 44 | 2119 |
| 763318 | N/A | N/A | 46238 | 46257 | GGATTTATGTAACAGGAATA | 53 | 2120 |
| 763319 | N/A | N/A | 46331 | 46350 | TGATTTAATACATATTTGCA | 33 | 2121 |
| 763320 | N/A | N/A | 46424 | 46443 | TCCACACTTCCCTCGATACT | 18 | 2122 |
| 763321 | N/A | N/A | 46529 | 46548 | GTGGTGGTGCCAGCAGTGGG | 39 | 2123 |
| 763322 | N/A | N/A | 46622 | 46641 | TACCACCCACAGCTGTGCCC | 43 | 2124 |
| 763323 | N/A | N/A | 46715 | 46734 | TAGAATAGTGCCTGTTTAAA | 19 | 2125 |
| 763324 | N/A | N/A | 46808 | 46827 | AATTGCCTTTTCTGTTTCTT | 48 | 2126 |
| 763325 | N/A | N/A | 46905 | 46924 | TACTAGCATAGTGTCTAGCA | 43 | 2127 |
| 763326 | N/A | N/A | 46998 | 47017 | ATACTCAGACATCTTAAGTC | 52 | 2128 |
| 763327 | N/A | N/A | 47093 | 47112 | GATGCCTGACACAAAATAGG | 54 | 2129 |
| 763328 | N/A | N/A | 47186 | 47205 | ATTATATTTTGCCTAACCTC | 0 | 2130 |
| 763329 | N/A | N/A | 47279 | 47298 | GAGAAAATCTGTCTCCTTGC | 27 | 2131 |
| 763330 | N/A | N/A | 47372 | 47391 | CATTGTGGGATTGTAAGTCT | 31 | 2132 |
| 763331 | N/A | N/A | 47465 | 47484 | TCACAATTACATTTTCTTGT | 53 | 2133 |
| 763332 | N/A | N/A | 47558 | 47577 | TATAGCATGAATTACTTTAC | 44 | 2134 |
| 763333 | N/A | N/A | 47651 | 47670 | TACCTCCTCTTCAGCAAGGA | 78 | 2135 |
| 763334 | N/A | N/A | 47744 | 47763 | CCTCTTGTAGTTTTTAAAAT | 27 | 2136 |
| 763335 | N/A | N/A | 47951 | 47970 | TTGGTTGTTCAAGTGATTCT | 33 | 2137 |
| 763336 | N/A | N/A | 48081 | 48100 | TCTCACAGTTTTGTTGTTGT | 57 | 2138 |
| 763337 | N/A | N/A | 48171 | 48190 | CTTTTCATCATGCCTTTATT | 40 | 2139 |
| 763338 | N/A | N/A | 48172 | 48191 | TCTTTTCATCATGCCTTTAT | 40 | 2140 |
| 763339 | N/A | N/A | 48173 | 48192 | ATCTTTTCATCATGCCTTTA | 37 | 2141 |

TABLE 35-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763340 | N/A | N/A | 48174 | 48193 | GATCTTTTCATCATGCCTTT | 55 | 2142 |
| 763341 | N/A | N/A | 48175 | 48194 | TGATCTTTTCATCATGCCTT | 70 | 2143 |
| 763342 | N/A | N/A | 48176 | 48195 | TTGATCTTTTCATCATGCCT | 51 | 2144 |
| 763343 | N/A | N/A | 48177 | 48196 | CTTGATCTTTTCATCATGCC | 59 | 2145 |
| 763344 | N/A | N/A | 48178 | 48197 | TCTTGATCTTTTCATCATGC | 60 | 2146 |
| 763345 | N/A | N/A | 48179 | 48198 | CTCTTGATCTTTTCATCATG | 38 | 2147 |
| 763346 | N/A | N/A | 48180 | 48199 | TCTCTTGATCTTTTCATCAT | 43 | 2148 |
| 763347 | N/A | N/A | 48181 | 48200 | ATCTCTTGATCTTTTCATCA | 36 | 2149 |
| 763348 | N/A | N/A | 48267 | 48286 | GGATTACTCCTGGCACAGCT | 62 | 2150 |
| 763349 | N/A | N/A | 48360 | 48379 | CGATGGAGTACCTACCAACT | 36 | 2151 |
| 763350 | N/A | N/A | 48453 | 48472 | TACGAGTAGAAGTGACTTGC | 53 | 2152 |
| 763351 | N/A | N/A | 48546 | 48565 | TCAGTGGAGAGCTATGCAAT | 5 | 2153 |
| 763352 | N/A | N/A | 48648 | 48667 | TGTAGAATACTTATTTTTTG | 28 | 2154 |
| 763353 | N/A | N/A | 48710 | 48729 | ATTTTGGATGCTTCTGAAGA | 24 | 2155 |
| 763354 | N/A | N/A | 48711 | 48730 | TATTTTGGATGCTTCTGAAG | 17 | 2156 |
| 763355 | N/A | N/A | 48712 | 48731 | GTATTTTGGATGCTTCTGAA | 63 | 2157 |
| 763356 | N/A | N/A | 48713 | 48732 | TGTATTTTGGATGCTTCTGA | 59 | 2158 |
| 763357 | N/A | N/A | 48714 | 48733 | TTGTATTTTGGATGCTTCTG | 54 | 2159 |
| 763358 | N/A | N/A | 48715 | 48734 | TTTGTATTTTGGATGCTTCT | 61 | 2160 |
| 763359 | N/A | N/A | 48716 | 48735 | GTTTGTATTTTGGATGCTTC | 63 | 2161 |
| 763360 | N/A | N/A | 48717 | 48736 | GGTTTGTATTTTGGATGCTT | 61 | 2162 |
| 763361 | N/A | N/A | 48718 | 48737 | TGGTTTGTATTTTGGATGCT | 40 | 2163 |
| 763362 | N/A | N/A | 48719 | 48738 | ATGGTTTGTATTTTGGATGC | 41 | 2164 |
| 763363 | N/A | N/A | 48720 | 48739 | GATGGTTTGTATTTTGGATG | 55 | 2165 |
| 763364 | N/A | N/A | 48741 | 48760 | ACGACATTTTCTTGCCTCTT | 74 | 2166 |
| 763365 | N/A | N/A | 48842 | 48861 | ATGCTTTCACTTGAAAAAAA | 25 | 2167 |
| 763366 | N/A | N/A | 48975 | 48994 | CTTTTTTTATTTAAATTCTT | 1 | 2168 |
| 763367 | N/A | N/A | 49144 | 49163 | ATGGAGAAACTACCCCCATG | 27 | 2169 |
| 763368 | N/A | N/A | 49239 | 49258 | ACCTCACATGGCAGGAGAAA | 32 | 2170 |
| 763369 | N/A | N/A | 49341 | 49360 | TTTTTATAAAGAAAGAAGTT | 0 | 2171 |
| 763370 | N/A | N/A | 49434 | 49453 | TCTTGCTTCTATGTTATATG | 65 | 2172 |

TABLE 36

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 79 | 33 |
| 741410 | N/A | N/A | 87946 | 87962 | GTAAGTTGTGACCATGC | 82 | 402 |
| 762837 | 238 | 257 | 4689 | 4708 | TGAATTCCTTTACACCACAC | 57 | 1639 |
| 763371 | N/A | N/A | 49527 | 49546 | CACCCACCATAAAAGGTGAT | 10 | 2173 |
| 763372 | N/A | N/A | 49620 | 49639 | TGCCTCTGTTTACAAAGCAA | 58 | 2174 |
| 763373 | N/A | N/A | 49713 | 49732 | TGGTTTCCTTTGGTGGCTTT | 74 | 2175 |
| 763374 | N/A | N/A | 49806 | 49825 | TTTCCTTAAGAGGAGCTCTC | 53 | 2176 |
| 763375 | N/A | N/A | 49899 | 49918 | GATGTAAGTGAGACAGCTCA | 56 | 2177 |
| 763376 | N/A | N/A | 49992 | 50011 | TTTAGGTAATGGTTTGGTAT | 47 | 2178 |
| 763377 | N/A | N/A | 50085 | 50104 | ATAGAGGTTATTATTCAGTA | 49 | 2179 |
| 763378 | N/A | N/A | 50178 | 50197 | AGGAAAACCATCTCTGCTAT | 36 | 2180 |
| 763379 | N/A | N/A | 50271 | 50290 | GGAAAGAGGTATGAGTGATG | 24 | 2181 |
| 763380 | N/A | N/A | 50364 | 50383 | GAGTGCTGCCTAAGTCTTGG | 50 | 2182 |
| 763381 | N/A | N/A | 50457 | 50476 | TTGCTAGCTAAAAGGAGGGT | 9 | 2183 |
| 763382 | N/A | N/A | 50550 | 50569 | CCAGTTCTAGTTGTACTAGT | 52 | 2184 |
| 763383 | N/A | N/A | 50660 | 50679 | AAAATGAACTTTTTTATTCG | 14 | 2185 |
| 763384 | N/A | N/A | 50753 | 50772 | TGCACATCTTTTGCCTGAAA | 70 | 2186 |
| 763385 | N/A | N/A | 50846 | 50865 | AACTAATCATTATTTTAGAC | 0 | 2187 |
| 763386 | N/A | N/A | 50915 | 50934 | CATCAATATCTGCAATAATA | 63 | 2188 |
| 763387 | N/A | N/A | 50916 | 50935 | TCATCAATATCTGCAATAAT | 64 | 2189 |
| 763388 | N/A | N/A | 50917 | 50936 | TTCATCAATATCTGCAATAA | 45 | 2190 |
| 763389 | N/A | N/A | 50918 | 50937 | TTTCATCAATATCTGCAATA | 64 | 2191 |
| 763390 | N/A | N/A | 50919 | 50938 | TTTTCATCAATATCTGCAAT | 49 | 2192 |
| 763391 | N/A | N/A | 50920 | 50939 | GTTTTCATCAATATCTGCAA | 76 | 2193 |
| 763392 | N/A | N/A | 50921 | 50940 | GGTTTTCATCAATATCTGCA | 60 | 2194 |
| 763393 | N/A | N/A | 50922 | 50941 | AGGTTTTCATCAATATCTGC | 73 | 2195 |
| 763394 | N/A | N/A | 50923 | 50942 | AAGGTTTTCATCAATATCTG | 77 | 2196 |
| 763395 | N/A | N/A | 50924 | 50943 | AAAGGTTTTCATCAATATCT | 65 | 2197 |
| 763396 | N/A | N/A | 50925 | 50944 | TAAAGGTTTTCATCAATATC | 36 | 2198 |
| 763397 | N/A | N/A | 50926 | 50945 | GTAAAGGTTTTCATCAATAT | 54 | 2199 |
| 763398 | N/A | N/A | 50939 | 50958 | AATTAAGAGGAAGGTAAAGG | 2 | 2200 |
| 763399 | N/A | N/A | 51032 | 51051 | AAATAATTTCAACATCAGTT | 20 | 2201 |
| 763400 | N/A | N/A | 51125 | 51144 | CAATAGCTTGCCAAAAATTC | 38 | 2202 |
| 763401 | N/A | N/A | 51218 | 51237 | ATTTTGTTTCATGGATGTTT | 53 | 2203 |
| 763402 | N/A | N/A | 51318 | 51337 | AGTCAACATAATTTTTTTG | 34 | 2204 |
| 763403 | N/A | N/A | 51412 | 51431 | TCAACAAGGCCTTACTTACG | 55 | 2205 |
| 763404 | N/A | N/A | 51505 | 51524 | TTATAAAATATCTTCCTAGG | 3 | 2206 |

TABLE 36-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763405 | N/A | N/A | 51598 | 51617 | TTTTGGCTGCCTCTCAAAAT | 21 | 2207 |
| 763406 | N/A | N/A | 51691 | 51710 | TTCATTAAAAATTCTGAGTT | 3 | 2208 |
| 763407 | N/A | N/A | 51792 | 51811 | ATTTTTAATATAATGCTACG | 0 | 2209 |
| 763408 | N/A | N/A | 51885 | 51904 | CACCAGTGTTTGCATGTCCC | 67 | 2210 |
| 763409 | N/A | N/A | 51978 | 51997 | CCTCCTACTTCCTAGGCTGC | 7 | 2211 |
| 763410 | N/A | N/A | 52071 | 52090 | GCTCAATTGGGTGTTCAGCA | 62 | 2212 |
| 763411 | N/A | N/A | 52164 | 52183 | ACACTGTAAAACTGTCACAA | 52 | 2213 |
| 763412 | N/A | N/A | 52310 | 52329 | CACATGGATGTATTTGTGCG | 49 | 2214 |
| 763413 | N/A | N/A | 52403 | 52422 | AGAAGTTTCAAGAACAGTCA | 45 | 2215 |
| 763414 | N/A | N/A | 52496 | 52515 | TTTAATATACAGATGTTCAG | 11 | 2216 |
| 763415 | N/A | N/A | 52589 | 52608 | CCCACCTGCCAAAAACACCT | 36 | 2217 |
| 763416 | N/A | N/A | 52682 | 52701 | TCGAAGTGGGTATGGATGCA | 50 | 2218 |
| 763417 | N/A | N/A | 52775 | 52794 | GGGCATATGGCTATATACTA | 51 | 2219 |
| 763418 | N/A | N/A | 52868 | 52887 | TCTAGTTAGCATCTATCCAC | 73 | 2220 |
| 763419 | N/A | N/A | 52961 | 52980 | TCTTATAAAATTTCTATACT | 13 | 2221 |
| 763420 | N/A | N/A | 53054 | 53073 | TCATTTTACTTAAGTGGCAC | 51 | 2222 |
| 763421 | N/A | N/A | 53147 | 53166 | GTCTTTTTCCCATCCTTGAC | 53 | 2223 |
| 763422 | N/A | N/A | 53240 | 53259 | TTAGCAAGTATAAATATGTT | 4 | 2224 |
| 763423 | N/A | N/A | 53333 | 53352 | TAGTTGATTGTAGGAAATGT | 48 | 2225 |
| 763424 | N/A | N/A | 53426 | 53445 | TTGCAAAACAGATGGACTTC | 43 | 2226 |
| 763425 | N/A | N/A | 53519 | 53538 | TGATGATCTAGCCAAGAGGG | 27 | 2227 |
| 763426 | N/A | N/A | 53612 | 53631 | ACAAGCTGTACATTAATTAC | 42 | 2228 |
| 763427 | N/A | N/A | 53640 | 53659 | TTCCATGAAGCCAAGATCAA | 46 | 2229 |
| 763428 | N/A | N/A | 53641 | 53660 | TTTCCATGAAGCCAAGATCA | 62 | 2230 |
| 763429 | N/A | N/A | 53642 | 53661 | ATTTCCATGAAGCCAAGATC | 63 | 2231 |
| 763430 | N/A | N/A | 53643 | 53662 | TATTTCCATGAAGCCAAGAT | 66 | 2232 |
| 763431 | N/A | N/A | 53644 | 53663 | TTATTTCCATGAAGCCAAGA | 61 | 2233 |
| 763432 | N/A | N/A | 53645 | 53664 | ATTATTTCCATGAAGCCAAG | 53 | 2234 |
| 763433 | N/A | N/A | 53646 | 53665 | AATTATTTCCATGAAGCCAA | 67 | 2235 |
| 763434 | N/A | N/A | 53647 | 53666 | GAATTATTTCCATGAAGCCA | 77 | 2236 |
| 763435 | N/A | N/A | 53648 | 53667 | TGAATTATTTCCATGAAGCC | 66 | 2237 |
| 763436 | N/A | N/A | 53649 | 53668 | GTGAATTATTTCCATGAAGC | 68 | 2238 |
| 763437 | N/A | N/A | 53650 | 53669 | AGTGAATTATTTCCATGAAG | 69 | 2239 |
| 763438 | N/A | N/A | 53705 | 53724 | AAGTAAGTTCTGAGCTGACA | 34 | 2240 |
| 763439 | N/A | N/A | 53798 | 53817 | TATTAAGTCTGTTAAGAGGT | 54 | 2241 |
| 763440 | N/A | N/A | 53891 | 53910 | ATGTTGTATGATGCTCTGGC | 74 | 2242 |

TABLE 36-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763441 | N/A | N/A | 53984 | 54003 | GTAGATTGCTATTTTGCCAC | 55 | 2243 |
| 763442 | N/A | N/A | 54080 | 54099 | AATGGGTTTATGTATAATCG | 58 | 2244 |
| 763443 | N/A | N/A | 54173 | 54192 | CTCCAGACATAGATCTCTCT | 63 | 2245 |
| 763444 | N/A | N/A | 54266 | 54285 | ACAAGTAAACTGAAACCAGA | 23 | 2246 |
| 763445 | N/A | N/A | 54359 | 54378 | GTAAGGATGATCATTATAAC | 55 | 2247 |
| 763446 | N/A | N/A | 54452 | 54471 | ATTAAACATTTTTAATAGCC | 27 | 2248 |
| 763447 | N/A | N/A | 54545 | 54564 | AGGTGAATAAACTTCGAAAT | 51 | 2249 |

TABLE 37

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 86 | 33 |
| 741410 | N/A | N/A | 87946 | 87962 | GTAAGTTGTGACCATGC | 93 | 402 |
| 762837 | 238 | 257 | 4689 | 4708 | TGAATTCCTTTACACCACAC | 68 | 1639 |
| 763448 | N/A | N/A | 54638 | 54657 | TATCAAAAGATTATATATAG | 0 | 2250 |
| 763449 | N/A | N/A | 54731 | 54750 | TAAATAACATGAATAAGACC | 21 | 2251 |
| 763450 | N/A | N/A | 54824 | 54843 | TTTTACACATAAGCATATAT | 18 | 2252 |
| 763451 | N/A | N/A | 54917 | 54936 | AATGAATGTTACCATTTTAT | 45 | 2253 |
| 763452 | N/A | N/A | 55011 | 55030 | CAATATATTTATTAGGAGAA | 30 | 2254 |
| 763453 | N/A | N/A | 55104 | 55123 | TCATAAATCAGTCCTCTATA | 36 | 2255 |
| 763454 | N/A | N/A | 55197 | 55216 | AAAAAGAAGTCAGATATTTC | 26 | 2256 |
| 763455 | N/A | N/A | 55290 | 55309 | TTTCGGCAGAATTCCAGAGA | 56 | 2257 |
| 763456 | N/A | N/A | 55383 | 55402 | TGGTTTTCTTTTTCTAGTCA | 73 | 2258 |
| 763457 | N/A | N/A | 55476 | 55495 | CTCACAAATCATAGGTTTGT | 25 | 2259 |
| 763458 | N/A | N/A | 55569 | 55588 | GACTATCAATCGGTACTTAT | 67 | 2260 |
| 763459 | N/A | N/A | 55663 | 55682 | ATTTTATTTGAAATATGTGA | 12 | 2261 |
| 763460 | N/A | N/A | 55756 | 55775 | GATCTTAGAAATTCATTTAG | 42 | 2262 |
| 763461 | N/A | N/A | 55849 | 55868 | TTCTCTAAGTACAACACTGC | 33 | 2263 |
| 763462 | N/A | N/A | 55942 | 55961 | CCACAGTTACATCTGGAAAC | 46 | 2264 |
| 763463 | N/A | N/A | 56051 | 56070 | AAGTTGTGCGACTTTGGGCA | 66 | 2265 |
| 763464 | N/A | N/A | 56144 | 56163 | TATCATCAGCAGAACATAGA | 36 | 2266 |
| 763465 | N/A | N/A | 56237 | 56256 | TAAATATTGTTTTTCTAAG | 1 | 2267 |
| 763466 | N/A | N/A | 56330 | 56349 | GACACATTTATATTAGATGT | 79 | 2268 |
| 763467 | N/A | N/A | 56423 | 56442 | AAGGAGGGAAACAAAGCTCC | 22 | 2269 |
| 763468 | N/A | N/A | 56516 | 56535 | TACTATATGACATGCTTTCT | 31 | 2270 |

TABLE 37-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763469 | N/A | N/A | 56612 | 56631 | CAATGGATGAATAGGTGGAT | 45 | 2271 |
| 763470 | N/A | N/A | 56705 | 56724 | ATGTTGTGGCTTAACCCCAT | 54 | 2272 |
| 763471 | N/A | N/A | 56798 | 56817 | AAAAAACCTGAAGTACAACA | 16 | 2273 |
| 763472 | N/A | N/A | 56891 | 56910 | TACTGTGGGTCATTTTTTCT | 44 | 2274 |
| 763473 | N/A | N/A | 56987 | 57006 | ATAATATCTATATTTAAAAC | 0 | 2275 |
| 763474 | N/A | N/A | 57082 | 57101 | TATAAAGATGGATTTTTAAA | 0 | 2276 |
| 763475 | N/A | N/A | 57175 | 57194 | AAATGGATGCTAAGACAATT | 35 | 2277 |
| 763476 | N/A | N/A | 57268 | 57287 | CCTTCTCTAACTGCCTTTAC | 24 | 2278 |
| 763477 | N/A | N/A | 57361 | 57380 | GTATAGTTAAAGCTACATTT | 59 | 2279 |
| 763478 | N/A | N/A | 57454 | 57473 | CAAATTTTGCTTTTACACCC | 63 | 2280 |
| 763479 | N/A | N/A | 57547 | 57566 | CTTACTTGAGCTAGGTGATC | 54 | 2281 |
| 763480 | N/A | N/A | 57640 | 57659 | TTCCTCTATTTAATGTATTT | 69 | 2282 |
| 763481 | N/A | N/A | 57733 | 57752 | TAGCAGTTCCAGGTTCCACA | 84 | 2283 |
| 763482 | N/A | N/A | 57826 | 57845 | ATCACTTTGGTGTGAGAAGA | 14 | 2284 |
| 763483 | N/A | N/A | 57919 | 57938 | ATTCCATAGACTTCCAAGTC | 60 | 2285 |
| 763484 | N/A | N/A | 58012 | 58031 | AGCATCCACATGAAATTGGT | 48 | 2286 |
| 763485 | N/A | N/A | 58105 | 58124 | GATGTCTTGATACCTTCAGA | 79 | 2287 |
| 763486 | N/A | N/A | 58198 | 58217 | CTACATGCTAAACTTGTTTT | 11 | 2288 |
| 763487 | N/A | N/A | 58291 | 58310 | GTGAGAATAAATGTGATCTA | 41 | 2289 |
| 763488 | N/A | N/A | 58384 | 58403 | CTGTTTCATTAGGAATTTTT | 68 | 2290 |
| 763489 | N/A | N/A | 58477 | 58496 | TTTATGTACATGGCCAGAAA | 32 | 2291 |
| 763490 | N/A | N/A | 58571 | 58590 | ACAAAAAATTTCCTAACATT | 2 | 2292 |
| 763491 | N/A | N/A | 58664 | 58683 | TGTAGCATTTACCTAACAGC | 83 | 2293 |
| 763492 | N/A | N/A | 58757 | 58776 | AGTGCAGAATCCTGATTGCA | 75 | 2294 |
| 763493 | N/A | N/A | 58850 | 58869 | CACATTGTAACATAAGCTGT | 48 | 2295 |
| 763494 | N/A | N/A | 58943 | 58962 | AGTTTGAACTCCGCCCAAGA | 32 | 2296 |
| 763495 | N/A | N/A | 59036 | 59055 | ACAAGGTTTGCACAAATAAA | 48 | 2297 |
| 763496 | N/A | N/A | 59129 | 59148 | CCTCATATATAGGGCCTCAC | 46 | 2298 |
| 763497 | N/A | N/A | 59222 | 59241 | AATTATAAAGCCCTGAAGGC | 1 | 2299 |
| 763498 | N/A | N/A | 59315 | 59334 | AATGTATTGTTATTTGTCAT | 68 | 2300 |
| 763499 | N/A | N/A | 59439 | 59458 | CAACTTCTCCATATAACCAA | 52 | 2301 |
| 763500 | N/A | N/A | 59592 | 59611 | CTAAAGGATGCAAAGGCATA | 23 | 2302 |
| 763501 | N/A | N/A | 59685 | 59704 | CGTAGATAGAGTTGGAGACC | 76 | 2303 |
| 763502 | N/A | N/A | 59788 | 59807 | GTGATATATTTACATATATA | 60 | 2304 |
| 763503 | N/A | N/A | 59945 | 59964 | TTCCAGCGATCCCACTCCTA | 26 | 2305 |
| 763504 | N/A | N/A | 60040 | 60059 | TTTTTTTACACTGCTGGTAG | 31 | 2306 |

TABLE 37-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763505 | N/A | N/A | 60161 | 60180 | TTTAATGACCAGGGAAATGC | 19 | 2307 |
| 763506 | N/A | N/A | 60418 | 60437 | GGGACCTAAAACTATAAAGC | 40 | 2308 |
| 763507 | N/A | N/A | 60540 | 60559 | CAAAACCTTAAAAATTATAG | 0 | 2309 |
| 763508 | N/A | N/A | 60744 | 60763 | AAATCCAGAAATAAAGCTAA | 18 | 2310 |
| 763509 | N/A | N/A | 60844 | 60863 | CTAGATTACCCAACTTCAAA | 4 | 2311 |
| 763510 | N/A | N/A | 60972 | 60991 | GACTCCCATCAAAATGCCAC | 37 | 2312 |
| 763511 | N/A | N/A | 61069 | 61088 | ACAGAAACTAATGAAAACAC | 0 | 2313 |
| 763512 | N/A | N/A | 61183 | 61202 | GAGCCTTTTACAACAGCTG | 61 | 2314 |
| 763513 | N/A | N/A | 61282 | 61301 | TTAATTCAGTAAAGTTTCCA | 11 | 2315 |
| 763514 | N/A | N/A | 61391 | 61410 | AGCATCCAAACTGCTAAAGA | 35 | 2316 |
| 763515 | N/A | N/A | 61499 | 61518 | TTTCCCCCGAGAACTGGAAT | 0 | 2317 |
| 763516 | N/A | N/A | 61592 | 61611 | CTGGCATATAAGATACACAC | 45 | 2318 |
| 763517 | N/A | N/A | 61691 | 61710 | GCAGGAGTAAAAACAAAAAT | 29 | 2319 |
| 763518 | N/A | N/A | 61966 | 61985 | GTTCCAAAAGATAGAGACAG | 37 | 2320 |
| 763519 | N/A | N/A | 62059 | 62078 | GTCAGGAAACAAAAAAAGTC | 15 | 2321 |
| 763520 | N/A | N/A | 62154 | 62173 | CATATATACAAACCTCCTAG | 14 | 2322 |
| 763521 | N/A | N/A | 62296 | 62315 | AAAGATCTAAACAAGCTCAA | 16 | 2323 |
| 763522 | N/A | N/A | 62399 | 62418 | CACAAAATACAATACAAAAG | 0 | 2324 |
| 763523 | N/A | N/A | 62496 | 62515 | AAGATCATACTGTTGCATTC | 14 | 2325 |
| 763524 | N/A | N/A | 62674 | 62693 | AGGCGGATCACCATAAGTCA | 0 | 2326 |

TABLE 38

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 80 | 33 |
| 741410 | N/A | N/A | 87946 | 87962 | GTAAGTTGTGACCATGC | 83 | 402 |
| 762837 | 238 | 257 | 4689 | 4708 | TGAATTCCTTTACACCACAC | 69 | 1639 |
| 763604 | N/A | N/A | 70405 | 70424 | TCATTTCCTTAGTTCCATAT | 45 | 2327 |
| 763605 | N/A | N/A | 70498 | 70517 | TCTGCCTTGTTTTTCTTTC | 65 | 2328 |
| 763606 | N/A | N/A | 70594 | 70613 | TATATAGTTATATATTTACG | 0 | 2329 |
| 763607 | N/A | N/A | 70687 | 70706 | TTTATATTATATTAACTCTA | 13 | 2330 |
| 763608 | N/A | N/A | 70780 | 70799 | GGCTTGTCTCTATCCCTGT | 65 | 2331 |
| 763609 | N/A | N/A | 70908 | 70927 | GCCCCAGCTTCCGGGTTCAA | 24 | 2332 |
| 763610 | N/A | N/A | 71001 | 71020 | GAAATATTATTTATACTATT | 0 | 2333 |
| 763611 | N/A | N/A | 71094 | 71113 | TCTCACAATCACAGAAAACA | 31 | 2334 |

TABLE 38-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763612 | N/A | N/A | 71187 | 71206 | GACTGCATTTGTATTTCATC | 89 | 2335 |
| 763613 | N/A | N/A | 71280 | 71299 | AGATTAACAAAATATTAATT | 10 | 2336 |
| 763614 | N/A | N/A | 71373 | 71392 | TATCATTCTTAACAGAAAAA | 20 | 2337 |
| 763615 | N/A | N/A | 71471 | 71490 | CTAAGCCATTTTATAACAGG | 33 | 2338 |
| 763616 | N/A | N/A | 71568 | 71587 | GCCTAACAGGCTATGGACCA | 47 | 2339 |
| 763617 | N/A | N/A | 71778 | 71797 | CACGGACAGGGATGGTGAGG | 52 | 2340 |
| 763618 | N/A | N/A | 71871 | 71890 | GTATTGGGCATTATCAGTAA | 65 | 2341 |
| 763619 | N/A | N/A | 71964 | 71983 | ACTTATCAACACTTAAACTG | 23 | 2342 |
| 763620 | N/A | N/A | 72074 | 72093 | TAGGTAATTCTAATTTTAAT | 6 | 2343 |
| 763621 | N/A | N/A | 72201 | 72220 | TACCTAGGTGGTTTCCATAT | 46 | 2344 |
| 763622 | N/A | N/A | 72294 | 72313 | AATGACAGGGTCTTCTCCTT | 58 | 2345 |
| 763623 | N/A | N/A | 72295 | 72314 | AAATGACAGGGTCTTCTCCT | 66 | 2346 |
| 763624 | N/A | N/A | 72296 | 72315 | CAAATGACAGGGTCTTCTCC | 60 | 2347 |
| 763625 | N/A | N/A | 72297 | 72316 | GCAAATGACAGGGTCTTCTC | 76 | 2348 |
| 763626 | N/A | N/A | 72298 | 72317 | GGCAAATGACAGGGTCTTCT | 68 | 2349 |
| 763627 | N/A | N/A | 72299 | 72318 | TGGCAAATGACAGGGTCTTC | 83 | 2350 |
| 763628 | N/A | N/A | 72300 | 72319 | GTGGCAAATGACAGGGTCTT | 77 | 2351 |
| 763629 | N/A | N/A | 72301 | 72320 | TGTGGCAAATGACAGGGTCT | 89 | 2352 |
| 763630 | N/A | N/A | 72302 | 72321 | TTGTGGCAAATGACAGGGTC | 73 | 2353 |
| 763631 | N/A | N/A | 72408 | 72427 | ACTTTTCTTTTTAGATTCC | 67 | 2354 |
| 763632 | N/A | N/A | 72630 | 72649 | TTCTCAACTGCCTGAGTAGC | 41 | 2355 |
| 763633 | N/A | N/A | 72756 | 72775 | TGTGTGGACTGTGTTTTTTG | 70 | 2356 |
| 763634 | N/A | N/A | 72849 | 72868 | CAGCTTTTTAGTTCCTCCTA | 84 | 2357 |
| 763635 | N/A | N/A | 72942 | 72961 | TTCCCCTGTGGCAAGAGCAG | 47 | 2358 |
| 763636 | N/A | N/A | 73035 | 73054 | ATGCTGTTATAAGATGAATG | 58 | 2359 |
| 763637 | N/A | N/A | 73128 | 73147 | AAATTATTATAATTCACTCT | 5 | 2360 |
| 763638 | N/A | N/A | 73185 | 73204 | ACTTTCTGTGTGGTATGTTC | 74 | 2361 |
| 763639 | N/A | N/A | 73186 | 73205 | GACTTTCTGTGTGGTATGTT | 76 | 2362 |
| 763640 | N/A | N/A | 73187 | 73206 | AGACTTTCTGTGTGGTATGT | 88 | 2363 |
| 763641 | N/A | N/A | 73188 | 73207 | CAGACTTTCTGTGTGGTATG | 86 | 2364 |
| 763642 | N/A | N/A | 73189 | 73208 | ACAGACTTTCTGTGTGGTAT | 70 | 2365 |
| 763643 | N/A | N/A | 73190 | 73209 | GACAGACTTTCTGTGTGGTA | 78 | 2366 |
| 763644 | N/A | N/A | 73191 | 73210 | AGACAGACTTTCTGTGTGGT | 65 | 2367 |
| 763645 | N/A | N/A | 73192 | 73211 | CAGACAGACTTTCTGTGTGG | 81 | 2368 |
| 763646 | N/A | N/A | 73193 | 73212 | TCAGACAGACTTTCTGTGTG | 51 | 2369 |
| 763647 | N/A | N/A | 73194 | 73213 | TTCAGACAGACTTTCTGTGT | 58 | 2370 |

TABLE 38-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763648 | N/A | N/A | 73195 | 73214 | CTTCAGACAGACTTTCTGTG | 60 | 2371 |
| 763649 | N/A | N/A | 73221 | 73240 | TTGTATTGGTGGAGAAAACA | 20 | 2372 |
| 763650 | N/A | N/A | 73314 | 73333 | GTGTTGAGAATTTTTCATTG | 82 | 2373 |
| 763651 | N/A | N/A | 73407 | 73426 | TAGCATCTCTAATGTAGTCT | 85 | 2374 |
| 763652 | N/A | N/A | 73500 | 73519 | GTAGCTGAATTTCTTCAGCA | 22 | 2375 |
| 763653 | N/A | N/A | 73593 | 73612 | ATTACAGTGAAATGAAACAT | 4 | 2376 |
| 763654 | N/A | N/A | 73686 | 73705 | AAATACATTTTGCCTCTGTC | 55 | 2377 |
| 763655 | N/A | N/A | 73779 | 73798 | CTTTAAGACTTTCCTTAGAC | 54 | 2378 |
| 763656 | N/A | N/A | 73872 | 73891 | TTTGTTTTAAAACTAGACTT | 27 | 2379 |
| 763657 | N/A | N/A | 73965 | 73984 | AAAAGAGATGAAAAGTGTG | 22 | 2380 |
| 763658 | N/A | N/A | 74058 | 74077 | AGATATGGAGGAGAGTGAAA | 28 | 2381 |
| 763659 | N/A | N/A | 74159 | 74178 | CTTCCCTCAGCAACAGGCGC | 51 | 2382 |
| 763660 | N/A | N/A | 74252 | 74271 | GGTCTAGAATCATTCTGAAG | 55 | 2383 |
| 763661 | N/A | N/A | 74345 | 74364 | AAGGACCTTTCTTCTGAAAG | 66 | 2384 |
| 763662 | N/A | N/A | 74438 | 74457 | TACACAGAGCACTTCTTATT | 41 | 2385 |
| 763663 | N/A | N/A | 74531 | 74550 | CTCCCTTTTTCCCACATCTA | 48 | 2386 |
| 763664 | N/A | N/A | 74624 | 74643 | AAATTAAGTGTTAAGCACAC | 60 | 2387 |
| 763665 | N/A | N/A | 74717 | 74736 | AAATATTTGCTCAGAGACAC | 59 | 2388 |
| 763666 | N/A | N/A | 74810 | 74829 | GAATAAAAATGTATAACTAT | 6 | 2389 |
| 763667 | N/A | N/A | 75104 | 75123 | CAGAGCCTGGCCAAAATGGC | 33 | 2390 |
| 763668 | N/A | N/A | 75197 | 75216 | AGCACTTAAACAGAAAAAAT | 27 | 2391 |
| 763669 | N/A | N/A | 75290 | 75309 | TCTATTGTATATTAGGTTGA | 67 | 2392 |
| 763670 | N/A | N/A | 75383 | 75402 | GATGAAGGAAGAATGATTTT | 49 | 2393 |
| 763671 | N/A | N/A | 75476 | 75495 | GCTAGTTCATTGTATGTGTC | 81 | 2394 |
| 763672 | N/A | N/A | 75569 | 75588 | ATTGAATAAAAATTTGTATT | 0 | 2395 |
| 763673 | N/A | N/A | 75943 | 75962 | CCAGGTATAAAATTTTTTTT | 35 | 2396 |
| 763674 | N/A | N/A | 76036 | 76055 | GATCTAAGAATACCCCTAGT | 25 | 2397 |
| 763675 | N/A | N/A | 76129 | 76148 | TTAGATAAAAGTATACTGT | 8 | 2398 |
| 763676 | N/A | N/A | 76222 | 76241 | GACAGTTTTCTAATTTTACA | 64 | 2399 |
| 763677 | N/A | N/A | 76315 | 76334 | GGGTTGGAAATAATACAGAG | 43 | 2400 |
| 763678 | N/A | N/A | 76408 | 76427 | TTGACCTGCAGTATCTTGAA | 28 | 2401 |
| 763679 | N/A | N/A | 76501 | 76520 | TACATATTCTTATTCAACTC | 46 | 2402 |
| 763680 | N/A | N/A | 76594 | 76613 | ATATTATTGATTGTTCTAAA | 14 | 2403 |

TABLE 39

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 57 | 33 |
| 741410 | N/A | N/A | 87946 | 87962 | GTAAGTTGTGACCATGC | 73 | 402 |
| 762837 | 238 | 257 | 4689 | 4708 | TGAATTCCTTTACACCACAC | 65 | 1639 |
| 763681 | N/A | N/A | 76687 | 76706 | GGATATTCGATTCAAGAACA | 56 | 2404 |
| 763682 | N/A | N/A | 76780 | 76799 | ATAAATTTGGAAGCTAATGT | 2 | 2405 |
| 763683 | N/A | N/A | 76873 | 76892 | ACCACATTTTGAAAATAAAG | 40 | 2406 |
| 763684 | N/A | N/A | 76966 | 76985 | AGCACAGGAAATTAACATAT | 62 | 2407 |
| 763685 | N/A | N/A | 77059 | 77078 | GTAGGTGTGTTTATTTCTAT | 66 | 2408 |
| 763686 | N/A | N/A | 77164 | 77183 | CTTTTCATCAGAGATTTTTT | 60 | 2409 |
| 763687 | N/A | N/A | 77257 | 77276 | GAAATCTAAAAACAGCAAAG | 3 | 2410 |
| 763688 | N/A | N/A | 77350 | 77369 | GACTATTGTTTAATGTGTT | 48 | 2411 |
| 763689 | N/A | N/A | 77443 | 77462 | GGGAGATTTGAGAGAGAGGC | 44 | 2412 |
| 763690 | N/A | N/A | 77536 | 77555 | ATAGTGGGCTTATGGTGTAC | 51 | 2413 |
| 763691 | N/A | N/A | 77630 | 77649 | ATTTCTCCATTTCTGTCACT | 41 | 2414 |
| 763692 | N/A | N/A | 77738 | 77757 | CAGGAGTAAGGACACAGACG | 42 | 2415 |
| 763693 | N/A | N/A | 77831 | 77850 | CCTCCAGAAAAGGTTTTTAG | 62 | 2416 |
| 763694 | N/A | N/A | 77924 | 77943 | GAATTGAAACTGCTTAGAAG | 28 | 2417 |
| 763695 | N/A | N/A | 78027 | 78046 | CCTGACTTTGAATTATTTTG | 55 | 2418 |
| 763696 | N/A | N/A | 78120 | 78139 | AAAATCAGATAGCAGTGGTG | 36 | 2419 |
| 763697 | N/A | N/A | 78213 | 78232 | AGGGTACAGAAGGAAAGACA | 37 | 2420 |
| 763698 | N/A | N/A | 78306 | 78325 | TGAGAGGTGTTTGTTTTGAA | 15 | 2421 |
| 763699 | N/A | N/A | 78399 | 78418 | TGTTGGCAAGCTTGAAGGGA | 44 | 2422 |
| 763700 | N/A | N/A | 78495 | 78514 | AATTGAAGGGTTGTAACAGG | 29 | 2423 |
| 763701 | N/A | N/A | 78588 | 78607 | GCTGGAAAATTAGTCTGTAG | 75 | 2424 |
| 763702 | N/A | N/A | 78681 | 78700 | CATGGCATGGTCTATACATT | 62 | 2425 |
| 763703 | N/A | N/A | 78774 | 78793 | AGGTCTCATGGCTGGCAAGT | 27 | 2426 |
| 763704 | N/A | N/A | 78867 | 78886 | AAACACTTTATCAAATCTTA | 41 | 2427 |
| 763705 | N/A | N/A | 78960 | 78979 | ATCAGAACAAGTTAAACATT | 34 | 2428 |
| 763706 | N/A | N/A | 79053 | 79072 | TCTTTTATTCTTGTATCACT | 70 | 2429 |
| 763707 | N/A | N/A | 79146 | 79165 | TAGCCTTTTGATCTGTTTTT | 56 | 2430 |
| 763708 | N/A | N/A | 79239 | 79258 | TAAGAATTATGTTAAAACCA | 16 | 2431 |
| 763709 | N/A | N/A | 79332 | 79351 | CTTAAATTTTAACAATTAAA | 0 | 2432 |
| 763710 | N/A | N/A | 79425 | 79444 | AATTTACCCCCTAGTAGGCT | 57 | 2433 |
| 763711 | N/A | N/A | 79518 | 79537 | AGTAACATTTTGAAATGATG | 57 | 2434 |
| 763712 | N/A | N/A | 79611 | 79630 | CCTGTAGTTCAGTTTTACTG | 63 | 2435 |
| 763713 | N/A | N/A | 79704 | 79723 | AGATATGAAAATTTTCACTT | 25 | 2436 |
| 763714 | N/A | N/A | 79797 | 79816 | CTTTTAACTTTAGCTAAATA | 0 | 2437 |

TABLE 39-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763715 | N/A | N/A | 79890 | 79909 | AGGACCAAAGCTATGGTTAG | 52 | 2438 |
| 763716 | N/A | N/A | 79983 | 80002 | CAAACAAATAACAGCTTTCA | 58 | 2439 |
| 763717 | N/A | N/A | 80076 | 80095 | ATAACAAAATTCAGTGCAAC | 56 | 2440 |
| 763718 | N/A | N/A | 80169 | 80188 | ACATTTAAAGTTTTAACACT | 12 | 2441 |
| 763719 | N/A | N/A | 80262 | 80281 | GTTTTATAGTTGACAGATGA | 53 | 2442 |
| 763720 | N/A | N/A | 80355 | 80374 | TCTCTAAATTTGTTGATTTA | 26 | 2443 |
| 763721 | N/A | N/A | 80448 | 80467 | TGCAGGCACTCACAAACATT | 68 | 2444 |
| 763722 | N/A | N/A | 80555 | 80574 | ACACCTTTTCTCTTCTTTTT | 48 | 2445 |
| 763723 | N/A | N/A | 80648 | 80667 | ATCTACTGTTTGAAAGGGTG | 61 | 2446 |
| 763724 | N/A | N/A | 80741 | 80760 | ACATTGCTCAGAGTTCATGT | 44 | 2447 |
| 763725 | N/A | N/A | 80834 | 80853 | TAGGTACCATCAGAATTTCA | 57 | 2448 |
| 763726 | N/A | N/A | 80927 | 80946 | TCATTCTCTGCTACAATAAA | 43 | 2449 |
| 763727 | N/A | N/A | 80987 | 81006 | GAAATTTTCCAGCTAAAAAA | 19 | 2450 |
| 763728 | N/A | N/A | 80988 | 81007 | TGAAATTTTCCAGCTAAAAA | 0 | 2451 |
| 763729 | N/A | N/A | 80989 | 81008 | TTGAAATTTTCCAGCTAAAA | 47 | 2452 |
| 763730 | N/A | N/A | 80990 | 81009 | CTTGAAATTTTCCAGCTAAA | 51 | 2453 |
| 763731 | N/A | N/A | 80991 | 81010 | TCTTGAAATTTTCCAGCTAA | 47 | 2454 |
| 763732 | N/A | N/A | 80992 | 81011 | ATCTTGAAATTTTCCAGCTA | 45 | 2455 |
| 763733 | N/A | N/A | 80993 | 81012 | AATCTTGAAATTTTCCAGCT | 59 | 2456 |
| 763734 | N/A | N/A | 80994 | 81013 | AAATCTTGAAATTTTCCAGC | 60 | 2457 |
| 763735 | N/A | N/A | 80995 | 81014 | TAAATCTTGAAATTTTCCAG | 23 | 2458 |
| 763736 | N/A | N/A | 80996 | 81015 | ATAAATCTTGAAATTTTCCA | 24 | 2459 |
| 763737 | N/A | N/A | 80997 | 81016 | CATAAATCTTGAAATTTTCC | 40 | 2460 |
| 763738 | N/A | N/A | 81020 | 81039 | ATTTCTTTCTCAAGCCCAAA | 53 | 2461 |
| 763739 | N/A | N/A | 81113 | 81132 | TACATTCCTACTGTATTTAC | 38 | 2462 |
| 763740 | N/A | N/A | 81206 | 81225 | TGCTTTGATATGGCTTGGAG | 64 | 2463 |
| 763741 | N/A | N/A | 81299 | 81318 | TGGTATGAGTCACATAAGTA | 76 | 2464 |
| 763742 | N/A | N/A | 81392 | 81411 | CCTAGAAATTTTGCCTTTTC | 40 | 2465 |
| 763743 | N/A | N/A | 81485 | 81504 | CTGCAGGTTCTGGAGAGCTG | 56 | 2466 |
| 763744 | N/A | N/A | 81578 | 81597 | TGTTTACTGCCACTATTCAC | 53 | 2467 |
| 763745 | N/A | N/A | 81681 | 81700 | CTAACTGAACTTTTAAAAAT | 4 | 2468 |
| 763746 | N/A | N/A | 81774 | 81793 | AATACAATCTATCAGCATTA | 53 | 2469 |
| 763747 | N/A | N/A | 81868 | 81887 | AATTTTGGAGGAATTTATTT | 0 | 2470 |
| 763748 | N/A | N/A | 81961 | 81980 | TTGTGCTTCAATAATACCAA | 37 | 2471 |
| 763749 | N/A | N/A | 82112 | 82131 | TGGGTTTCATGGTGTTAGCT | 69 | 2472 |
| 763750 | N/A | N/A | 82237 | 82256 | GTAGGCTCAGTGCAAACTCT | 57 | 2473 |

TABLE 39-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763751 | N/A | N/A | 82330 | 82349 | AGTCTTTTTACATTATAATA | 28 | 2474 |
| 763752 | N/A | N/A | 82423 | 82442 | TAACAGATTTGTGGTGAAAA | 52 | 2475 |
| 763753 | N/A | N/A | 82516 | 82535 | AACCATAAGAGAGGACAAAC | 39 | 2476 |
| 763754 | N/A | N/A | 82609 | 82628 | AATGATCTTTAAAACATTCA | 9 | 2477 |
| 763755 | N/A | N/A | 82702 | 82721 | GAGGACAATAAAATGACCTT | 70 | 2478 |
| 763756 | N/A | N/A | 82810 | 82829 | CTCCTCTCAACTGCCAGCGC | 52 | 2479 |
| 763757 | N/A | N/A | 82903 | 82922 | TTTACTAAGTCATCTGTGAA | 19 | 2480 |

TABLE 40

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 75 | 33 |
| 741410 | N/A | N/A | 87946 | 87962 | GTAAGTTGTGACCATGC | 84 | 402 |
| 762837 | 238 | 257 | 4689 | 4708 | TGAATTCCTTTACACCACAC | 63 | 1639 |
| 763758 | N/A | N/A | 82996 | 83015 | CTTATGAGCTGTTTAGGAAG | 45 | 2481 |
| 763759 | N/A | N/A | 83089 | 83108 | TGTCAACTCTGCCAATGTGA | 56 | 2482 |
| 763760 | N/A | N/A | 83183 | 83202 | AATAAATGCTATGTAATTTA | 3 | 2483 |
| 763761 | N/A | N/A | 83276 | 83295 | GAAGGGTTGCTATGATAGTT | 56 | 2484 |
| 763762 | N/A | N/A | 83369 | 83388 | TGAATTCTAACCAAAAGCTT | 33 | 2485 |
| 763763 | N/A | N/A | 83462 | 83481 | GACAAATGTGTCACTTTTTA | 11 | 2486 |
| 763764 | N/A | N/A | 83555 | 83574 | AAATTCATGAGGAATGCAAT | 41 | 2487 |
| 763765 | N/A | N/A | 83648 | 83667 | CATACAATATTTTTGACAGA | 50 | 2488 |
| 763766 | N/A | N/A | 83741 | 83760 | GTGACGCACATTTACACCAG | 61 | 2489 |
| 763767 | N/A | N/A | 83834 | 83853 | AAAGATTTTTATCTTAGCCT | 42 | 2490 |
| 763768 | N/A | N/A | 83927 | 83946 | CCATTTACAAAGATGACCAG | 22 | 2491 |
| 763769 | N/A | N/A | 84020 | 84039 | TCAAAGTAGTGAATTACATC | 51 | 2492 |
| 763770 | N/A | N/A | 84113 | 84132 | TGTTTGGACTTATAAACTAT | 55 | 2493 |
| 763771 | N/A | N/A | 84206 | 84225 | TAATGGGCAAGCAAAAAATT | 0 | 2494 |
| 763772 | N/A | N/A | 84552 | 84571 | TCATGTTGCCTAGGCTAGAA | 58 | 2495 |
| 763773 | N/A | N/A | 84645 | 84664 | CTAGATAACATACAATATAA | 0 | 2496 |
| 763774 | N/A | N/A | 84752 | 84771 | GAGAAATTATTATATTTTAT | 0 | 2497 |
| 763775 | N/A | N/A | 84845 | 84864 | AGACTACAAAATTGCTAAAA | 32 | 2498 |
| 763776 | N/A | N/A | 84938 | 84957 | CAAAAGATTTTTATGGAGT | 3 | 2499 |
| 763777 | N/A | N/A | 85031 | 85050 | AATTTAAGTTTAAATATTCT | 0 | 2500 |
| 763778 | N/A | N/A | 85124 | 85143 | CCTCATTTTGCCAGTATTAA | 76 | 2501 |

TABLE 40-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763779 | N/A | N/A | 85217 | 85236 | ATGGGAAAATTGTGACTGTT | 59 | 2502 |
| 763780 | N/A | N/A | 85315 | 85334 | GCAAATATATGAATTTTTA | 12 | 2503 |
| 763781 | N/A | N/A | 85424 | 85443 | TCATTGGAAAATCTTGAACG | 61 | 2504 |
| 763782 | N/A | N/A | 85517 | 85536 | ATTTGTAGACCTATGTTGAA | 10 | 2505 |
| 763783 | N/A | N/A | 85610 | 85629 | GAATAATAAGATTCAGTCAT | 56 | 2506 |
| 763784 | N/A | N/A | 85703 | 85722 | GAAACCATTAAAATATTTAT | 0 | 2507 |
| 763785 | N/A | N/A | 85797 | 85816 | TCTAAGTTTTTATTAATTAA | 0 | 2508 |
| 763786 | N/A | N/A | 85891 | 85910 | ATGATTAGGATTTTTATTTC | 1 | 2509 |
| 763787 | N/A | N/A | 85984 | 86003 | TTTATATTTAAATCACACAA | 0 | 2510 |
| 763788 | N/A | N/A | 86077 | 86096 | AATTGCTGTTTTAATCATGA | 54 | 2511 |
| 763789 | N/A | N/A | 86170 | 86189 | CAGATTTATCTACTTGAAAC | 46 | 2512 |
| 763790 | N/A | N/A | 86263 | 86282 | GTAGAGTTTTTGGTCAGTGG | 63 | 2513 |
| 763791 | N/A | N/A | 86356 | 86375 | TTTTTGTTCTTGGGATGTTG | 53 | 2514 |
| 763792 | N/A | N/A | 86449 | 86468 | TAACTTTCAACCGTGAAAAA | 15 | 2515 |
| 763793 | N/A | N/A | 86542 | 86561 | GTCTGTTTTCTAACTAGCTT | 76 | 2516 |
| 763794 | N/A | N/A | 86635 | 86654 | GCACATTGTCAAATAAACAA | 61 | 2517 |
| 763795 | N/A | N/A | 86728 | 86747 | CAGGAATTATCCAAAGTCAC | 70 | 2518 |
| 763796 | N/A | N/A | 86821 | 86840 | ACCTGGGTTAAGTAAATGGC | 38 | 2519 |
| 763797 | N/A | N/A | 86914 | 86933 | CACTGGAGAGACTGTGAAGG | 53 | 2520 |
| 763798 | N/A | N/A | 87007 | 87026 | AGCAGCAGATTTCAAAAGGG | 69 | 2521 |
| 763799 | N/A | N/A | 87100 | 87119 | TTTTGATTGTGGTAATTGGA | 36 | 2522 |
| 763800 | N/A | N/A | 87193 | 87212 | TACAAGAGTGGAAATGGCTG | 27 | 2523 |
| 763801 | N/A | N/A | 87286 | 87305 | CCGTTACATGCTCTCTAATT | 46 | 2524 |
| 763802 | N/A | N/A | 87379 | 87398 | CTCCTGATCTCAATTGAAAT | 10 | 2525 |
| 763803 | N/A | N/A | 87472 | 87491 | AAGCCTTCATATACGAGTTT | 60 | 2526 |
| 763804 | N/A | N/A | 87565 | 87584 | TATCTCCAGCCTTCACCTCT | 13 | 2527 |
| 763805 | N/A | N/A | 87658 | 87677 | TCTCCTTCTTACAAAATCCA | 53 | 2528 |
| 763806 | N/A | N/A | 87759 | 87778 | GTTGTTCTTCTTCTTATTAT | 58 | 2529 |
| 763807 | N/A | N/A | 87854 | 87873 | GTTAAAATTTGAAATAATGA | 0 | 2530 |
| 763808 | N/A | N/A | 87940 | 87959 | AGTTGTGACCATGCAATAAA | 50 | 2531 |
| 763809 | N/A | N/A | 87941 | 87960 | AAGTTGTGACCATGCAATAA | 51 | 2532 |
| 763810 | N/A | N/A | 87942 | 87961 | TAAGTTGTGACCATGCAATA | 44 | 2533 |
| 763811 | N/A | N/A | 87943 | 87962 | GTAAGTTGTGACCATGCAAT | 65 | 2534 |
| 763812 | N/A | N/A | 87944 | 87963 | AGTAAGTTGTGACCATGCAA | 69 | 2535 |
| 763813 | N/A | N/A | 87945 | 87964 | TAGTAAGTTGTGACCATGCA | 68 | 2536 |
| 763814 | N/A | N/A | 87946 | 87965 | TTAGTAAGTTGTGACCATGC | 55 | 2537 |

TABLE 40-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763815 | N/A | N/A | 87947 | 87966 | ATTAGTAAGTTGTGACCATG | 44 | 2538 |
| 763816 | N/A | N/A | 87948 | 87967 | CATTAGTAAGTTGTGACCAT | 42 | 2539 |
| 763817 | N/A | N/A | 87949 | 87968 | CCATTAGTAAGTTGTGACCA | 71 | 2540 |
| 763818 | N/A | N/A | 87950 | 87969 | CCCATTAGTAAGTTGTGACC | 71 | 2541 |
| 763819 | N/A | N/A | 88040 | 88059 | GCTATCAAGACATTATGTAG | 58 | 2542 |
| 763820 | N/A | N/A | 88133 | 88152 | ATCTATGAAAGCAAATGTTT | 35 | 2543 |
| 763821 | N/A | N/A | 88227 | 88246 | CTTTTTTAAACAAAATACAG | 0 | 2544 |
| 763822 | N/A | N/A | 88320 | 88339 | ATGCTACAAGCAGGCACTTA | 22 | 2545 |
| 763823 | N/A | N/A | 88413 | 88432 | TCTGTTATCTTAAGAGGCTT | 76 | 2546 |
| 763824 | N/A | N/A | 88506 | 88525 | TGGACTTTATTGCTCAAAGC | 65 | 2547 |
| 763825 | N/A | N/A | 88599 | 88618 | CAGACAAAAACATCCGATAT | 28 | 2548 |
| 763826 | N/A | N/A | 88692 | 88711 | CCCTAGACAACTATCACCTG | 9 | 2549 |
| 763827 | N/A | N/A | 88785 | 88804 | TGGAAGCCCTGAGGAAGTGG | 59 | 2550 |
| 763828 | N/A | N/A | 88878 | 88897 | AACAGCAAGGACAATGTCTA | 53 | 2551 |
| 763829 | N/A | N/A | 88971 | 88990 | GCCATGTGTTATATACTTTG | 73 | 2552 |
| 763830 | N/A | N/A | 89075 | 89094 | ATTAGGTAGATTTTTTTTAA | 0 | 2553 |
| 763831 | N/A | N/A | 89169 | 89188 | ATGATGGTGAATAAATTAAA | 11 | 2554 |
| 763832 | N/A | N/A | 89262 | 89281 | AGAAAATGCTTTAAGCTCAT | 57 | 2555 |
| 763833 | N/A | N/A | 89355 | 89374 | AAAAGATAAATTGCTAGGTT | 16 | 2556 |
| 763834 | N/A | N/A | 89452 | 89471 | ACTAATTAATTAGTTGAATA | 8 | 2557 |

TABLE 41

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 67 | 33 |
| 741410 | N/A | N/A | 87946 | 87962 | GTAAGTTGTGACCATGC | 83 | 402 |
| 762837 | 238 | 257 | 4689 | 4708 | TGAATTCCTTTACACCACAC | 76 | 1639 |
| 763835 | N/A | N/A | 89545 | 89564 | TCAATTCTCTTTAGAATTTC | 27 | 2558 |
| 763836 | N/A | N/A | 89638 | 89657 | AGAGATTCATGCTCATTTAT | 45 | 2559 |
| 763837 | N/A | N/A | 89731 | 89750 | ATCTATCCACTCTCCTATAG | 0 | 2560 |
| 763838 | N/A | N/A | 89824 | 89843 | ACTTTTTATTAGAGCCCCC | 14 | 2561 |
| 763839 | N/A | N/A | 89917 | 89936 | GACTACATGTCCTTTAAATG | 64 | 2562 |
| 763840 | N/A | N/A | 90015 | 90034 | AAGACTGCAGGCTTGAGCCA | 23 | 2563 |
| 763841 | N/A | N/A | 90141 | 90160 | ATGCCACCACATCCCACTTT | 21 | 2564 |
| 763842 | N/A | N/A | 90312 | 90331 | TGTTATATTTTAAAAGTTTC | 0 | 2565 |

TABLE 41-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763843 | N/A<br>N/A | N/A<br>N/A | 90439<br>90405 | 90458<br>90424 | ATATACACAAAAGCAGATAT | 19 | 2566 |
| 763844 | N/A | N/A | 90500 | 90519 | AAATATATGTGTAAATACAC | 0 | 2567 |
| 763845 | N/A | N/A | 90593 | 90612 | CTCCCATTCTCTCTCTCTAC | 35 | 2568 |
| 763846 | N/A | N/A | 90686 | 90705 | CCCAGAAACTAACATCTTCT | 48 | 2569 |
| 763847 | N/A | N/A | 90779 | 90798 | CAGGAAAAGAATACTTTCT | 34 | 2570 |
| 763848 | N/A | N/A | 90945 | 90964 | TCCTGCCACCACACCCACTA | 11 | 2571 |
| 763849 | N/A | N/A | 91047 | 91066 | TAGCTATAGTGCAATGGCGC | 7 | 2572 |
| 763850 | N/A | N/A | 91140 | 91159 | TTTCATAACTGTATGATTTG | 33 | 2573 |
| 763851 | N/A | N/A | 91233 | 91252 | ACCATTAAAAGTTTAGTGGA | 43 | 2574 |
| 763852 | N/A | N/A | 91326 | 91345 | ATGTGCATGCCAGTGTGTTA | 34 | 2575 |
| 763853 | N/A | N/A | 91419 | 91438 | GATAAAGAAGGAATGCACAA | 34 | 2576 |
| 763854 | N/A | N/A | 91520 | 91539 | CTTACTTTCTTGCAAAAGGG | 43 | 2577 |
| 763855 | N/A | N/A | 91614 | 91633 | GAAAATAAAAAGGCAGCTTT | 13 | 2578 |
| 763856 | N/A | N/A | 91707 | 91726 | TAATAGTGAATGTTGTTTTA | 21 | 2579 |
| 763857 | N/A | N/A | 91800 | 91819 | CATGCATCTAAAGATAACTG | 33 | 2580 |
| 763858 | N/A | N/A | 91893 | 91912 | TCCTAGGCTTTGTCTCTTAA | 38 | 2581 |
| 763859 | N/A | N/A | 91986 | 92005 | TTTAAAACTTTATCTTCCTT | 35 | 2582 |
| 763860 | N/A | N/A | 92079 | 92098 | AGATACTGTTGCCCCAAGTA | 48 | 2583 |
| 763861 | N/A | N/A | 92172 | 92191 | TACTAAAAAAAACCACTAAC | 0 | 2584 |
| 763862 | N/A | N/A | 92265 | 92284 | CCACTGTCTAACAAATAATG | 32 | 2585 |
| 763863 | N/A | N/A | 92358 | 92377 | ATGATTGGTGTAAGCGAATG | 24 | 2586 |
| 763864 | N/A | N/A | 92451 | 92470 | ATTATCCTTCAACAGAGCTA | 21 | 2587 |
| 763865 | N/A | N/A | 92544 | 92563 | GCCCATCCTTAGATCTTAGT | 46 | 2588 |
| 763866 | N/A | N/A | 92642 | 92661 | CGAGTGACTCAGTTTCCTTA | 64 | 2589 |
| 763867 | N/A | N/A | 92735 | 92754 | CCTTCACTTTGGAGGATGCG | 37 | 2590 |
| 763868 | N/A | N/A | 92828 | 92847 | CCTAGAGGGTGCCTTCCCAG | 28 | 2591 |
| 763869 | N/A | N/A | 92921 | 92940 | ATATTTACACTGCTTCATAA | 3 | 2592 |
| 763870 | N/A | N/A | 93014 | 93033 | TTATGACCTGTAATGTACTT | 25 | 2593 |
| 763871 | N/A | N/A | 93151 | 93170 | CAAAAGACAAGCACACACAC | 0 | 2594 |
| 763872 | N/A | N/A | 93244 | 93263 | TAAGTATTTTTAGTACTTTA | 14 | 2595 |
| 763873 | N/A | N/A | 93337 | 93356 | GAGGGACTTTTGCAATTGTC | 15 | 2596 |
| 763874 | N/A | N/A | 93430 | 93449 | GAATCAAATAAGAGGTCAA | 35 | 2597 |
| 763875 | N/A | N/A | 93521 | 93540 | TTTTGAGTTCCAGGGATTCA | 54 | 2598 |
| 763876 | N/A | N/A | 93522 | 93541 | GTTTTGAGTTCCAGGGATTC | 70 | 2599 |
| 763877 | N/A | N/A | 93523 | 93542 | TGTTTTGAGTTCCAGGGATT | 74 | 2600 |
| 763878 | N/A | N/A | 93524 | 93543 | ATGTTTTGAGTTCCAGGGAT | 50 | 2601 |

TABLE 41-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763879 | N/A | N/A | 93525 | 93544 | AATGTTTTGAGTTCCAGGGA | 57 | 2602 |
| 763880 | N/A | N/A | 93526 | 93545 | CAATGTTTTGAGTTCCAGGG | 57 | 2603 |
| 763881 | N/A | N/A | 93527 | 93546 | GCAATGTTTTGAGTTCCAGG | 61 | 2604 |
| 763882 | N/A | N/A | 93528 | 93547 | AGCAATGTTTTGAGTTCCAG | 68 | 2605 |
| 763883 | N/A | N/A | 93529 | 93548 | CAGCAATGTTTTGAGTTCCA | 70 | 2606 |
| 763884 | N/A | N/A | 93530 | 93549 | TCAGCAATGTTTTGAGTTCC | 66 | 2607 |
| 763885 | N/A | N/A | 93531 | 93550 | TTCAGCAATGTTTTGAGTTC | 33 | 2608 |
| 763886 | N/A | N/A | 93621 | 93640 | GCATTTCTTAATTTTTTTAT | 6 | 2609 |
| 763887 | N/A | N/A | 93714 | 93733 | TTGTCTGCTACTATTTTTTC | 25 | 2610 |
| 763888 | N/A | N/A | 93807 | 93826 | TTTAATATTTATGAATGTGA | 15 | 2611 |
| 763889 | N/A | N/A | 93900 | 93919 | AAGCCTTTATTTTTTATTGC | 8 | 2612 |
| 763890 | N/A | N/A | 93993 | 94012 | ATGAGGGCAAGCTGGCTTTT | 40 | 2613 |
| 763891 | N/A | N/A | 94086 | 94105 | CAAGGAGATTGAGTTTACCA | 51 | 2614 |
| 763892 | N/A | N/A | 94179 | 94198 | CAAAGCATTCTTGCTTGCTC | 50 | 2615 |
| 763893 | N/A | N/A | 94272 | 94291 | TAATTTATGTCAGTCATTAA | 0 | 2616 |
| 763894 | N/A | N/A | 94365 | 94384 | GGCTGCCGAAAGCAGGAAAA | 32 | 2617 |
| 763895 | N/A | N/A | 94458 | 94477 | TTTAAATGTCACAGCTATTT | 15 | 2618 |
| 763896 | N/A | N/A | 94551 | 94570 | CTTCCCCTAAATCTCTCTGT | 20 | 2619 |
| 763897 | N/A | N/A | 94644 | 94663 | AGTTAACAAATTAATGAAAC | 10 | 2620 |
| 763898 | N/A | N/A | 94993 | 95012 | AACTTCAGTTTTGTGGCGGG | 15 | 2621 |
| 763899 | N/A | N/A | 95086 | 95105 | CCTGGAAAATGAGGACTTTC | 44 | 2622 |
| 763900 | N/A | N/A | 95179 | 95198 | ACTGATTAAGAAATGTGAGG | 31 | 2623 |
| 763901 | N/A | N/A | 95272 | 95291 | TGAAAGCCACCGTGATGAAC | 4 | 2624 |
| 763902 | N/A | N/A | 95365 | 95384 | AGATTAAAGCGATTCCTGCT | 12 | 2625 |
| 763903 | N/A | N/A | 95459 | 95478 | CTTAGTATCATCATCATCAC | 39 | 2626 |
| 763904 | N/A | N/A | 95552 | 95571 | CCCAGAAAATAAGCAGACTG | 45 | 2627 |
| 763905 | N/A | N/A | 95645 | 95664 | GCAAATACAATATTTGAAAG | 0 | 2628 |
| 763906 | N/A | N/A | 95738 | 95757 | GATCAGAATGACCAGTGCAC | 43 | 2629 |
| 763907 | N/A | N/A | 95831 | 95850 | TCAAACTATAATTTGGTGTC | 61 | 2630 |
| 763908 | N/A | N/A | 95924 | 95943 | TCTAGAGAATGATTCATCTT | 39 | 2631 |
| 763909 | N/A | N/A | 96017 | 96036 | TACCCTCTTGCTATACAAAC | 30 | 2632 |
| 763910 | N/A | N/A | 96110 | 96129 | GATGAAAATTGAAATTTGAT | 13 | 2633 |
| 763911 | N/A | N/A | 96203 | 96222 | TTAAAAATAACTGTATTTGG | 0 | 2634 |

TABLE 42

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 74 | 33 |
| 741410 | N/A | N/A | 87946 | 87962 | GTAAGTTGTGACCATGC | 80 | 402 |
| 762837 | 238 | 257 | 4689 | 4708 | TGAATTCCTTTACACCACAC | 67 | 1639 |
| 763912 | N/A | N/A | 96296 | 96315 | ATTAACTAAAAACCAAGTCT | 7 | 2635 |
| 763913 | N/A | N/A | 96391 | 96410 | CAAAGCTGCAGACCATTTTG | 25 | 2636 |
| 763914 | N/A | N/A | 96484 | 96503 | ACAGGCAAAGAATTTTTGAG | 35 | 2637 |
| 763915 | N/A | N/A | 96577 | 96596 | AAACAACTGCTGAGAAGCAG | 0 | 2638 |
| 763916 | N/A | N/A | 96670 | 96689 | TTTAATTGCTGTTGTGTGGT | 45 | 2639 |
| 763917 | N/A | N/A | 96763 | 96782 | TAAGACATAAATGTCAGAGG | 25 | 2640 |
| 763918 | N/A | N/A | 96858 | 96877 | TGAAGATGAAGAAAGGAAAG | 2 | 2641 |
| 763919 | N/A | N/A | 96951 | 96970 | GAGCCAATAACAGAGATGAT | 36 | 2642 |
| 763920 | N/A | N/A | 97044 | 97063 | AGACTGTTAATGTAGTAGGA | 29 | 2643 |
| 763921 | N/A | N/A | 97137 | 97156 | GGACAATTAATTTTGAGGGT | 48 | 2644 |
| 763922 | N/A | N/A | 97230 | 97249 | CTTCAGGAGATAAAGGAACC | 7 | 2645 |
| 763923 | N/A | N/A | 97323 | 97342 | TTATGCTTCAGGGATGCATA | 36 | 2646 |
| 763924 | N/A | N/A | 97416 | 97435 | TTTACTAAGTAATTGGTACT | 26 | 2647 |
| 763925 | N/A | N/A | 97509 | 97528 | AAGGCAGCAAAGAGGTAAAA | 2 | 2648 |
| 763926 | N/A | N/A | 97602 | 97621 | GGTAAGTCATCAGAGTTCAT | 27 | 2649 |
| 763927 | N/A | N/A | 97695 | 97714 | TTGAGTCTGAGATGCCTCCA | 34 | 2650 |
| 763928 | N/A | N/A | 97788 | 97807 | TTTGAGCTTGACCAACTAGG | 45 | 2651 |
| 763929 | N/A | N/A | 97881 | 97900 | GCAGTTACTGACTTGCTTGA | 38 | 2652 |
| 763930 | N/A | N/A | 97974 | 97993 | GCTGCAAGCACACCTGCCTT | 36 | 2653 |
| 763931 | N/A | N/A | 98067 | 98086 | AAGAGGAACGCAGAGCTCAG | 8 | 2654 |
| 763932 | N/A | N/A | 98160 | 98179 | GAGTATCATGATTTTCTTGC | 57 | 2655 |
| 763933 | N/A | N/A | 98253 | 98272 | CAAGCCTGCCAGTCTTTTGA | 43 | 2656 |
| 763934 | N/A | N/A | 98346 | 98365 | TATAGGTGCAAACTACAAGT | 35 | 2657 |
| 763935 | N/A | N/A | 98439 | 98458 | GGAATACAGCCAAAAACTTG | 13 | 2658 |
| 763936 | N/A | N/A | 98532 | 98551 | AGCTACATTCAAGTCTGCAA | 57 | 2659 |
| 763937 | N/A | N/A | 98803 | 98822 | CGAATGGGCGGATCACAAGG | 7 | 2660 |
| 763938 | N/A | N/A | 98896 | 98915 | AAGAATCGAAACTAAAAACC | 9 | 2661 |
| 763939 | N/A | N/A | 98989 | 99008 | AATGTATATCATATATTGTC | 57 | 2662 |
| 763940 | N/A | N/A | 99082 | 99101 | GACCCATGCACAGTCATAAT | 36 | 2663 |
| 763941 | N/A | N/A | 99175 | 99194 | CGTAAATGTTTCAACTGAAA | 45 | 2664 |
| 763942 | N/A | N/A | 99268 | 99287 | GTTGGAAGCTCAGGAGAAAA | 56 | 2665 |
| 763943 | N/A | N/A | 99361 | 99380 | TTGTTGAGGAACTGAAATTG | 20 | 2666 |
| 763944 | N/A | N/A | 99454 | 99473 | AGTGGGCTTGTGGTATTTGT | 7 | 2667 |
| 763945 | N/A | N/A | 99547 | 99566 | GCAAAGGGAGAACAAACAAA | 0 | 2668 |

TABLE 42-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763946 | N/A | N/A | 99641 | 99660 | CTGTATATAATTTTTTCAAC | 35 | 2669 |
| 763947 | N/A | N/A | 99734 | 99753 | ACTAAATGTTTATTTGCATT | 44 | 2670 |
| 763948 | N/A | N/A | 99827 | 99846 | GAATTTAAAGAGGAATAAAA | 0 | 2671 |
| 763949 | N/A | N/A | 99920 | 99939 | AATTTCATTATGATTATCGC | 64 | 2672 |
| 763950 | N/A | N/A | 100013 | 100032 | TCTTCAAACCTTTTGACCAA | 41 | 2673 |
| 763951 | N/A | N/A | 100111 | 100130 | GAAATAAATTGTTCATTTTG | 7 | 2674 |
| 763952 | N/A | N/A | 100205 | 100224 | GAAAAAATAGTTTATTATAA | 0 | 2675 |
| 763953 | N/A | N/A | 100298 | 100317 | TATATGATTTTTTGCAAGGG | 41 | 2676 |
| 763954 | N/A | N/A | 100394 | 100413 | GTTAAAGGAAATGTTTATAT | 12 | 2677 |
| 763955 | N/A | N/A | 100487 | 100506 | AAATTAATCCTTTCCAAATG | 0 | 2678 |
| 763956 | N/A | N/A | 100580 | 100599 | AATATTAGTTGTCAAATGTC | 42 | 2679 |
| 763957 | N/A | N/A | 100673 | 100692 | CTCTTTGAGGAAGTTACTAC | 23 | 2680 |
| 763958 | N/A | N/A | 100766 | 100785 | AATAACAATAACAGTTAATG | 0 | 2681 |
| 763959 | N/A | N/A | 100860 | 100879 | GATTATCAAGAAAGATAATG | 0 | 2682 |
| 763960 | N/A | N/A | 100953 | 100972 | GCTACTTTCTTTCAGTTACC | 49 | 2683 |
| 763961 | N/A | N/A | 101046 | 101065 | GCCAGAGGACCATAGTGGTT | 45 | 2684 |
| 763962 | N/A | N/A | 101143 | 101162 | TACTAAGTGAAGTTTGAGGG | 18 | 2685 |
| 763963 | N/A | N/A | 101236 | 101255 | AGAAAGGCTTTAAGATAGCT | 9 | 2686 |
| 763964 | N/A | N/A | 101329 | 101348 | AAGGATGGGCTCTGAAGCAG | 13 | 2687 |
| 763965 | N/A | N/A | 101422 | 101441 | CCCAGGAGTTTGCTCTCAAA | 36 | 2688 |
| 763966 | N/A | N/A | 101515 | 101534 | AGAGTCTGCTTTCATATTTT | 36 | 2689 |
| 763967 | N/A | N/A | 101914 | 101933 | TGGAGGCAGGTCTTTTTTTT | 32 | 2690 |
| 763968 | N/A | N/A | 102007 | 102026 | ACGATGTGAAGATGGGTCAA | 45 | 2691 |
| 763969 | N/A | N/A | 102100 | 102119 | TTAAACTATATTCAAATTTG | 0 | 2692 |
| 763970 | N/A | N/A | 102193 | 102212 | AATGCACAAAGGGAAATCTG | 38 | 2693 |
| 763971 | N/A | N/A | 102286 | 102305 | AATTAGCTGACTCACCTAAT | 4 | 2694 |
| 763972 | N/A | N/A | 102379 | 102398 | AGCAAAGAGGTAGTATGCTG | 61 | 2695 |
| 763973 | N/A | N/A | 102472 | 102491 | GTTTAAATACATTCAACCAT | 46 | 2696 |
| 763974 | N/A | N/A | 102565 | 102584 | GGTTTGGCAGTGGAGGAGAG | 28 | 2697 |
| 763975 | N/A | N/A | 102658 | 102677 | CCCTTCTAGCTGTTTCTTTA | 40 | 2698 |
| 763976 | N/A | N/A | 102831 | 102850 | TATAGAGATGAAGTTTCATT | 29 | 2699 |
| 763977 | N/A | N/A | 102982 | 103001 | CCCTATTGCCCAGGCTGTAA | 21 | 2700 |
| 763978 | N/A | N/A | 103075 | 103094 | CTTTAGAGAACCCAGTCTTA | 38 | 2701 |
| 763979 | N/A | N/A | 103175 | 103194 | ATAGTCACATTGGTGAACGC | 33 | 2702 |
| 763980 | N/A | N/A | 103268 | 103287 | TTGCTCTCCCTCAGTTATGT | 52 | 2703 |
| 763981 | N/A | N/A | 103361 | 103380 | TGCTATTATATATGCTAAGC | 54 | 2704 |

TABLE 42-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 763982 | N/A | N/A | 103454 | 103473 | CTGATGATCTCTGGTGCCAC | 35 | 2705 |
| 763983 | N/A | N/A | 103547 | 103566 | CTACTAACCTGTAAAAGACA | 1 | 2706 |
| 763984 | N/A | N/A | 103640 | 103659 | ACTTTACAACAAGATAAAAA | 0 | 2707 |
| 763985 | N/A | N/A | 103733 | 103752 | TCTGGTACAGTCCTACTACC | 61 | 2708 |
| 763986 | N/A | N/A | 103826 | 103845 | AATATAATTTATAGCATTAC | 0 | 2709 |
| 763987 | N/A | N/A | 103919 | 103938 | TGAGGCAATATGCAGACGAA | 51 | 2710 |
| 763988 | N/A | N/A | 104012 | 104031 | TTTAGAAATGCATCAAAGTG | 18 | 2711 |

TABLE 43

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 740410 | 240 | 256 | 4691 | 4707 | GAATTCCTTTACACCAC | 89 | 33 |
| 741410 | N/A | N/A | 87946 | 87962 | GTAAGTTGTGACCATGC | 90 | 402 |
| 762837 | 238 | 257 | 4689 | 4708 | TGAATTCCTTTACACCACAC | 79 | 1639 |
| 763989 | N/A | N/A | 104105 | 104124 | CAAACTTTAATTTTGGGAA | 31 | 2712 |
| 763990 | N/A | N/A | 104198 | 104217 | TGTATCCAATGCCCAAAGGA | 49 | 2713 |
| 763991 | N/A | N/A | 104291 | 104310 | CATTTATTGTTTACATACTC | 29 | 2714 |
| 763992 | N/A | N/A | 104384 | 104403 | GCAAAACAATATGCATATTT | 63 | 2715 |
| 763993 | N/A | N/A | 104477 | 104496 | GAGGTCTTGTTTTGGAAAGG | 54 | 2716 |
| 763994 | N/A | N/A | 104570 | 104589 | TGGATACTCTGATTTCTCTT | 76 | 2717 |
| 763995 | N/A | N/A | 104663 | 104682 | AGCAAAGGGCATCTGATTCA | 46 | 2718 |
| 763996 | N/A | N/A | 104756 | 104775 | ACCTTGTTAAAAAGCAAGGT | 2 | 2719 |
| 763997 | N/A | N/A | 104849 | 104868 | GGAGTGTGTACATAGTGTAG | 46 | 2720 |
| 763998 | N/A | N/A | 104942 | 104961 | AAAATGAAATCAAGCCCAGA | 23 | 2721 |
| 763999 | N/A | N/A | 105035 | 105054 | GAGATAGTAGCCAAAAAGAT | 22 | 2722 |
| 764000 | N/A | N/A | 105128 | 105147 | TTGTTTTGCTGCATTATTGA | 42 | 2723 |
| 764001 | N/A | N/A | 105221 | 105240 | CAACTTTCACAGCCTTAAAC | 38 | 2724 |
| 764002 | N/A | N/A | 105314 | 105333 | TTTGGAGCAATGTGATGTTT | 40 | 2725 |
| 764003 | N/A | N/A | 105407 | 105426 | GAGCTGCAGCAAGTTTTTTC | 56 | 2726 |
| 764004 | N/A | N/A | 105502 | 105521 | GCTGCTCTTTGAGAAAGTTC | 64 | 2727 |
| 764005 | N/A | N/A | 105595 | 105614 | AAGAAAAATTGAAATTCAAG | 9 | 2728 |
| 764006 | N/A | N/A | 105688 | 105707 | AAAATAGCAAGGTTTCATCA | 17 | 2729 |
| 764007 | N/A | N/A | 105781 | 105800 | TTAAAAAGATATGCTCATT | 12 | 2730 |
| 764008 | N/A | N/A | 105874 | 105893 | CACTGCCCGACATCACCAAT | 20 | 2731 |
| 764009 | N/A | N/A | 105967 | 105986 | AACCACACTCTTCTAGAATC | 41 | 2732 |

TABLE 43-continued

Percent reduction of human SNCA mRNA with 5-10-5 MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 764010 | N/A | N/A | 106060 | 106079 | TAAGGAAATTATCTTTATTC | 27 | 2733 |
| 764011 | N/A | N/A | 106153 | 106172 | TGTCTTTAGGAATACAACTA | 55 | 2734 |
| 764012 | N/A | N/A | 106246 | 106265 | GCTAATAGCTTATTGGGAAG | 47 | 2735 |
| 764013 | N/A | N/A | 106339 | 106358 | GGGTTGAATAGCTGATATAA | 65 | 2736 |
| 764014 | N/A | N/A | 106432 | 106451 | AGACTTAAAAGCTATATTAG | 6 | 2737 |
| 764015 | N/A | N/A | 106525 | 106544 | TCAGTTCAGTATCTTATATC | 68 | 2738 |
| 764016 | N/A | N/A | 106618 | 106637 | ACCTTTTATTCTCTCTCTAC | 60 | 2739 |
| 764017 | N/A | N/A | 106713 | 106732 | TAAAATAAATGAGAAAAACG | 2 | 2740 |
| 764018 | N/A | N/A | 106806 | 106825 | CCAATATAACAAATGTTAAA | 24 | 2741 |
| 764019 | N/A | N/A | 106899 | 106918 | GAGTATTCATGACTTGTTTT | 53 | 2742 |
| 764020 | N/A | N/A | 106999 | 107018 | TGTTATCTATAAAGAAATAT | 17 | 2743 |
| 764021 | N/A | N/A | 107092 | 107111 | AATATAACAACAAACACTTC | 2 | 2744 |
| 764022 | N/A | N/A | 107185 | 107204 | TATGTTTTTCTGAATATGTG | 36 | 2745 |
| 764023 | N/A | N/A | 107278 | 107297 | GCAATTTCAGGTGTCCTAGT | 79 | 2746 |
| 764024 | N/A | N/A | 107434 | 107453 | CCCACATAACTTTTATTACA | 42 | 2747 |
| 764025 | N/A | N/A | 107539 | 107558 | CGTGGTTTTGTTTTCCATGG | 70 | 2748 |
| 764026 | N/A | N/A | 107641 | 107660 | ATCTATCTAGGTTTGGGTGG | 57 | 2749 |
| 764027 | N/A | N/A | 107734 | 107753 | TTATTTCTTTAGGTGTGATG | 49 | 2750 |
| 764028 | N/A | N/A | 107827 | 107846 | ATTCTCATTGGGAACCCTAC | 40 | 2751 |
| 764029 | N/A | N/A | 107920 | 107939 | GTAAATTGCAACTAAAAGA | 8 | 2752 |
| 764030 | N/A | N/A | 108013 | 108032 | AAACATGTTCATTGCTTACA | 57 | 2753 |
| 764031 | N/A | N/A | 108271 | 108290 | GGTTCTCCTATAGTCCCAGC | 58 | 2754 |
| 764032 | N/A | N/A | 108364 | 108383 | ACATGATCGGTGAGGTCAGG | 40 | 2755 |
| 764033 | N/A | N/A | 108457 | 108476 | TCGACAATAGGGTTTACGAC | 56 | 2756 |
| 764034 | N/A | N/A | 108550 | 108569 | TTAAGTGGGCTATTGTTCAC | 39 | 2757 |
| 764035 | N/A | N/A | 108643 | 108662 | ACTATTGATGAAGTTAAGTG | 14 | 2758 |
| 764036 | N/A | N/A | 108736 | 108755 | TGCCATAGGACTTAATTCTT | 69 | 2759 |
| 764037 | N/A | N/A | 108857 | 108876 | TTGACTTGTTTGTATTAATC | 62 | 2760 |
| 764038 | N/A | N/A | 108970 | 108989 | CCTGCAGTAATGGAACAGCG | 67 | 2761 |
| 764039 | N/A | N/A | 109063 | 109082 | TGAACTTTGAAGGATGTACA | 40 | 2762 |
| 764040 | N/A | N/A | 109156 | 109175 | CTACCCTGTTTGTTGTTTGA | 15 | 2763 |
| 764041 | N/A | N/A | 109249 | 109268 | TTTTCCATGATTTTGAAACT | 30 | 2764 |
| 764042 | N/A | N/A | 109342 | 109361 | ACAACAGGGAGAAGGAAACG | 17 | 2765 |
| 764043 | N/A | N/A | 109435 | 109454 | ATGACAGAGCTTTTGTGATG | 35 | 2766 |
| 764044 | N/A | N/A | 109528 | 109547 | TTCACTTCTTGGTAGATACG | 45 | 2767 |
| 764045 | N/A | N/A | 109627 | 109646 | CTAAAAAAATCCAAATAAT | 14 | 2768 |

TABLE 43-continued

Percent reduction of human SNCA mRNA with 5-10-5
MOE gapmers with mixed internucleoside linkages

| Compound No | SEQ ID No: 1 start | SEQ ID No: 1 stop | SEQ ID No: 2 start | SEQ ID No: 2 stop | Sequence (5' to 3') | % Reduction | SEQ ID NO |
|---|---|---|---|---|---|---|---|
| 764046 | N/A | N/A | 109720 | 109739 | AGTAAGAAAAGGTCACACTA | 34 | 2769 |
| 764047 | N/A | N/A | 109813 | 109832 | ATTTTCAACAACATGTCTGA | 14 | 2770 |
| 764048 | N/A | N/A | 109906 | 109925 | AAAGGTAAGTGAAAATTCAA | 29 | 2771 |
| 764049 | N/A | N/A | 109999 | 110018 | CTCAGCCTGAAATGGTCATG | 39 | 2772 |
| 764050 | N/A | N/A | 110092 | 110111 | AGACTGAGACTATACATATT | 29 | 2773 |
| 764051 | N/A | N/A | 110185 | 110204 | AACTTTTATAACCACTTATA | 31 | 2774 |
| 764052 | N/A | N/A | 110278 | 110297 | AAAGGTAAAAAGTTTGGAAG | 6 | 2775 |
| 764053 | N/A | N/A | 110371 | 110390 | ATTATGTAACAACTACCTAT | 8 | 2776 |
| 764054 | N/A | N/A | 110624 | 110643 | GTTACAATGAAACCCCATCT | 29 | 2777 |
| 764055 | N/A | N/A | 110724 | 110743 | TTATTGCTGGGTGCAGTGGT | 24 | 2778 |
| 764056 | N/A | N/A | 110817 | 110836 | CCAAAGATATTTTCACAAG | 65 | 2779 |
| 764057 | N/A | N/A | 110910 | 110929 | AAACATTGCGGCAACATGGG | 22 | 2780 |
| 764058 | N/A | N/A | 111003 | 111022 | AAATCTTACATATAGGGATG | 39 | 2781 |
| 764059 | N/A | N/A | 111097 | 111116 | TCCTTCTTCATTCTAATATT | 7 | 2782 |

TABLE 44

Percent reduction of human SNCA mRNA with 5-10-5
MOE gapmers with mixed internucleoside linkages

| Compound No | SEQ ID No: 2 start | SEQ ID No: 2 stop | SEQ ID No: 5 start | SEQ ID No: 5 stop | Sequence (5' to 3') | % Reduction | SEQ ID NO |
|---|---|---|---|---|---|---|---|
| 740410 | 4691 | 4707 | N/A | N/A | GAATTCCTTTACACCAC | 89 | 33 |
| 741410 | 87946 | 87962 | N/A | N/A | GTAAGTTGTGACCATGC | 90 | 402 |
| 762837 | 4689 | 4708 | N/A | N/A | TGAATTCCTTTACACCACAC | 79 | 1639 |
| 764060 | N/A | N/A | 38 | 57 | CTTTACACCACACTCTTTCA | 23 | 2783 |
| 764061 | N/A | N/A | 39 | 58 | CCTTTACACCACACTCTTTC | 45 | 2784 |
| 764062 | N/A | N/A | 40 | 59 | TCCTTTACACCACACTCTTT | 56 | 2785 |
| 764063 | N/A | N/A | 41 | 60 | TTCCTTTACACCACACTCTT | 52 | 2786 |
| 764064 | N/A | N/A | 42 | 61 | ATTCCTTTACACCACACTCT | 70 | 2787 |
| 764065 | N/A | N/A | 43 | 62 | AATTCCTTTACACCACACTC | 67 | 2788 |

Example 6: Design of Gapmers with Mixed Internucleoside Linkages Complementary to Human SNCA Modified oligonucleotides complementary to a human SNCA nucleic acid were designed. The modified oligonucleotides in Table 45 are gapmers. The gapmers have a central gap segment that comprises 2'-deoxynucleosides and is flanked by wing segments on both the 5' end on the 3' end comprising 2'-MOE nucleosides and cEt nucleosides. All cytosine residues throughout each gapmer are 5-methyl cytosines. The internucleoside linkages are mixed phosphodiester internucleoside linkages and phosphorothioate internucleoside linkages. The sequence and chemical notation column specifies the sequence, including 5'-methy cytosines, sugar chemistry, and the internucleoside linkage chemistry, wherein subscript 'd' represents a 2'-deoxyribose sugar; subscript 'e' represents a 2'-MOE modified sugar; subscript 'k' represents a cEt modified sugar; subscript 'o' represents a phosphodiester internucleoside linkage; subscript 's' represents a phosphorothioate internucleoside linkage; and a 'm' superscript before the cytosine residue indicates a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the Tables below is complementary to human SNCA nucleic acid sequences SEQ ID NO: 2 or SEQ ID NO:5, as indicated. 'N/A' indicates that the modified oligonucleotide is not complementary to that particular nucleic acid with 100% complementarity.

TABLE 45

Modified oligonucleotides complementary to human SNCA mRNA

| Compound No | SEQ ID No: 2 start | SEQ ID No: 2 stop | SEQ ID No: 5 start | SEQ ID No: 5 stop | Sequence and chemical notation (5' to 3') | SEQ ID NO: |
|---|---|---|---|---|---|---|
| 788813 | N/A | N/A | 4686 | 4702 | $^mC_{es}{}^mC_{eo}T_{eo}T_{eo}T_{ds}A_{ds}{}^mC_{ds}A_{ds}{}^mC_{ds}{}^mC_{ds}A_{ds}{}^mC_{ds}A_{ds}{}^mC_{ko}T_{es}G_{es}G_e$ | 1038 |
| 788814 | 236 | 252 | 4687 | 4703 | $T_{es}{}^mC_{eo}{}^mC_{eo}T_{eo}T_{ds}A_{ds}T_{ds}A_{ds}{}^mC_{ds}A_{ds}{}^mC_{ds}{}^mC_{ds}A_{ds}{}^mC_{ds}A_{ko}{}^mC_{es}T_{es}G_e$ | 260 |
| 788815 | 237 | 253 | 4688 | 4704 | $T_{es}T_{eo}{}^mC_{eo}{}^mC_{eo}T_{ds}T_{ds}T_{ds}A_{ds}{}^mC_{ds}A_{ds}{}^mC_{ds}{}^mC_{ds}A_{ds}{}^mC_{ko}A_{es}{}^mC_{es}T_e$ | 335 |
| 788816 | 238 | 254 | 4689 | 4705 | $A_{es}T_{eo}T_{eo}{}^mC_{eo}{}^mC_{ds}T_{ds}T_{ds}T_{ds}A_{ds}{}^mC_{ds}A_{ds}{}^mC_{ds}{}^mC_{ds}A_{ko}{}^mC_{es}A_{es}{}^mC_e$ | 412 |
| 788817 | 239 | 255 | 4690 | 4706 | $A_{es}A_{eo}T_{eo}T_{eo}{}^mC_{ds}{}^mC_{ds}T_{ds}T_{ds}T_{ds}A_{ds}{}^mC_{ds}A_{ds}{}^mC_{ds}{}^mC_{ko}A_{es}{}^mC_{es}A_e$ | 577 |
| 788818 | 240 | 256 | 4691 | 4707 | $G_{es}A_{eo}A_{eo}T_{eo}T_{ds}{}^mC_{ds}{}^mC_{ds}T_{ds}T_{ds}T_{ds}A_{ds}{}^mC_{ds}A_{ds}{}^mC_{ko}{}^mC_{es}A_{es}{}^mC_e$ | 33 |
| 788819 | N/A | N/A | 4686 | 4702 | $^mC_{es}{}^mC_{eo}T_{eo}T_{es}T_{ds}A_{ds}{}^mC_{ds}A_{ds}{}^mC_{ds}{}^mC_{ds}A_{ds}{}^mC_{ds}A_{ds}{}^mC_{ko}T_{es}G_{es}G_e$ | 1038 |
| 788820 | 236 | 252 | 4687 | 4703 | $T_{es}{}^mC_{eo}{}^mC_{eo}T_{es}T_{ds}A_{ds}T_{ds}A_{ds}{}^mC_{ds}A_{ds}{}^mC_{ds}{}^mC_{ds}A_{ds}{}^mC_{ds}A_{ko}{}^mC_{es}T_{es}G_e$ | 260 |
| 788821 | 237 | 253 | 4688 | 4704 | $T_{es}T_{eo}{}^mC_{eo}{}^mC_{es}T_{ds}T_{ds}T_{ds}A_{ds}{}^mC_{ds}A_{ds}{}^mC_{ds}{}^mC_{ds}A_{ds}{}^mC_{ko}A_{es}{}^mC_{es}T_e$ | 335 |
| 788822 | 238 | 254 | 4689 | 4705 | $A_{es}T_{eo}T_{eo}{}^mC_{es}{}^mC_{ds}T_{ds}T_{ds}T_{ds}A_{ds}{}^mC_{ds}A_{ds}{}^mC_{ds}{}^mC_{ds}A_{ko}{}^mC_{es}A_{es}{}^mC_e$ | 412 |
| 788823 | 239 | 255 | 4690 | 4706 | $A_{es}A_{eo}T_{eo}T_{es}{}^mC_{ds}{}^mC_{ds}T_{ds}T_{ds}T_{ds}A_{ds}{}^mC_{ds}A_{ds}{}^mC_{ds}{}^mC_{ko}A_{es}{}^mC_{es}A_e$ | 577 |
| 788824 | 240 | 256 | 4691 | 4707 | $G_{es}A_{eo}A_{eo}T_{es}T_{ds}{}^mC_{ds}{}^mC_{ds}T_{ds}T_{ds}T_{ds}A_{ds}{}^mC_{ds}A_{ds}{}^mC_{ko}{}^mC_{es}A_{es}{}^mC_e$ | 33 |
| 788830 | 236 | 252 | 4687 | 4703 | $T_{es}{}^mC_{eo}{}^mC_{es}T_{es}T_{ds}A_{ds}T_{ds}A_{ds}{}^mC_{ds}A_{ds}{}^mC_{ds}{}^mC_{ds}A_{ds}{}^mC_{ds}A_{ko}{}^mC_{es}T_{es}G_e$ | 260 |
| 788831 | 237 | 253 | 4688 | 4704 | $T_{es}T_{eo}{}^mC_{es}{}^mC_{es}T_{ds}T_{ds}T_{ds}A_{ds}{}^mC_{ds}A_{ds}{}^mC_{ds}{}^mC_{ds}A_{ds}{}^mC_{ko}A_{es}{}^mC_{es}T_e$ | 335 |
| 788832 | 238 | 254 | 4689 | 4705 | $A_{es}T_{eo}T_{es}{}^mC_{es}{}^mC_{ds}T_{ds}T_{ds}T_{ds}A_{ds}{}^mC_{ds}A_{ds}{}^mC_{ds}{}^mC_{ds}A_{ko}{}^mC_{es}A_{es}{}^mC_e$ | 412 |
| 788833 | 239 | 255 | 4690 | 4706 | $A_{es}A_{eo}T_{es}T_{es}{}^mC_{ds}{}^mC_{ds}T_{ds}T_{ds}T_{ds}A_{ds}{}^mC_{ds}A_{ds}{}^mC_{ds}{}^mC_{ko}A_{es}{}^mC_{es}A_e$ | 577 |
| 788855 | N/A | N/A | 29458 | 29474 | $T_{es}T_{eo}T_{eo}G_{es}T_{ds}T_{ds}A_{ds}A_{ds}T_{ds}A_{ds}G_{ds}T_{ds}T_{ds}{}^mC_{ko}T_{ks}{}^mC_{es}T_e$ | 2789 |
| 788856 | N/A | N/A | 29459 | 29475 | $T_{es}T_{eo}T_{eo}T_{es}G_{ds}T_{ds}T_{ds}A_{ds}A_{ds}T_{ds}A_{ds}G_{ds}T_{ds}T_{ko}{}^mC_{ks}T_{es}{}^mC_e$ | 2790 |
| 788889 | N/A | N/A | 29458 | 29474 | $T_{es}T_{eo}T_{eo}G_{es}T_{ds}T_{ds}A_{ds}A_{ds}T_{ds}A_{ds}G_{ds}T_{ds}T_{ds}{}^mC_{ko}T_{es}{}^mC_{es}T_e$ | 2789 |
| 788890 | N/A | N/A | 29459 | 29475 | $T_{es}T_{eo}T_{eo}T_{es}G_{ds}T_{ds}T_{ds}A_{ds}A_{ds}T_{ds}A_{ds}G_{ds}T_{ds}T_{ko}{}^mC_{es}T_{es}{}^mC_e$ | 2790 |
| 789229 | N/A | N/A | 4686 | 4705 | $A_{es}T_{eo}T_{eo}{}^mC_{es}{}^mC_{es}T_{ds}T_{ds}T_{ds}A_{ds}{}^mC_{ds}A_{ds}{}^mC_{ds}{}^mC_{ds}A_{ds}{}^mC_{ds}A_{eo}{}^mC_{eo}T_{es}G_{es}G_e$ | 1682 |
| 789230 | 237 | 256 | 4688 | 4707 | $G_{es}A_{eo}A_{eo}T_{es}T_{es}{}^mC_{ds}{}^mC_{ds}T_{ds}T_{ds}T_{ds}A_{ds}{}^mC_{ds}A_{ds}{}^mC_{ds}{}^mC_{ds}A_{eo}{}^mC_{eo}A_{es}{}^mC_{es}T_e$ | 1638 |

TABLE 45-continued

Modified oligonucleotides complementary to human SNCA mRNA

| Compound No | SEQ ID No: 2 start | SEQ ID No: 2 stop | SEQ ID No: 5 start | SEQ ID No: 5 stop | Sequence and chemical notation (5' to 3') | SEQ ID NO: |
|---|---|---|---|---|---|---|
| 789231 | 238 | 257 | 4689 | 4708 | $T_{es}G_{eo}A_{eo}A_{es}T_{es}T_{ds}{}^mC_{ds}{}^mC_{ds}T_{ds}T_{ds}T_{ds}A_{ds}{}^mC_{ds}A_{ds}{}^mC_{ds}{}^mC_{eo}A_{eo}{}^mC_{es}A_{es}{}^mC_e$ | 1639 |
| 789232 | 239 | 258 | 4690 | 4709 | $A_{es}T_{eo}G_{es}A_{es}A_{es}T_{ds}T_{ds}{}^mC_{ds}{}^mC_{ds}T_{ds}T_{ds}T_{ds}A_{ds}{}^mC_{ds}A_{ds}{}^mC_{eo}{}^mC_{eo}A_{es}{}^mC_{es}A_e$ | 1640 |
| 789233 | 240 | 259 | 4691 | 4710 | $A_{es}A_{eo}T_{es}G_{es}A_{es}A_{ds}T_{ds}T_{ds}{}^mC_{ds}{}^mC_{ds}T_{ds}T_{ds}T_{ds}A_{ds}{}^mC_{ds}A_{eo}{}^mC_{eo}{}^mC_{es}A_{es}{}^mC_e$ | 1641 |
| 789234 | N/A | N/A | 29457 | 29476 | $T_{es}T_{eo}T_{eo}T_{es}T_{es}G_{ds}T_{ds}T_{ds}A_{ds}A_{ds}T_{ds}A_{ds}G_{ds}T_{ds}T_{ds}{}^mC_{eo}T_{eo}{}^mC_{es}T_{es}G_e$ | 1904 |
| 789235 | N/A | N/A | 4686 | 4705 | $A_{es}T_{eo}T_{es}{}^mC_{es}{}^mC_{es}T_{ds}T_{ds}T_{ds}A_{ds}{}^mC_{ds}A_{ds}{}^mC_{ds}{}^mC_{ds}A_{ds}{}^mC_{ds}A_{eo}{}^mC_{eo}T_{es}G_{es}G_e$ | 1682 |
| 789236 | 237 | 256 | 4688 | 4707 | $G_{es}A_{eo}A_{es}T_{es}T_{es}{}^mC_{ds}{}^mC_{ds}T_{ds}T_{ds}T_{ds}A_{ds}{}^mC_{ds}A_{ds}{}^mC_{ds}{}^mC_{ds}A_{eo}{}^mC_{eo}A_{es}{}^mC_{es}T_e$ | 1638 |
| 789237 | 238 | 257 | 4689 | 4708 | $T_{es}G_{eo}A_{es}A_{es}T_{es}T_{ds}{}^mC_{ds}{}^mC_{ds}T_{ds}T_{ds}T_{ds}A_{ds}{}^mC_{ds}A_{ds}{}^mC_{ds}{}^mC_{eo}A_{eo}{}^mC_{es}A_{es}{}^mC_e$ | 1639 |
| 789238 | 239 | 258 | 4690 | 4709 | $A_{es}T_{eo}G_{es}A_{es}A_{es}T_{ds}T_{ds}{}^mC_{ds}{}^mC_{ds}T_{ds}T_{ds}T_{ds}A_{ds}{}^mC_{ds}A_{ds}{}^mC_{eo}{}^mC_{eo}A_{es}{}^mC_{es}A_e$ | 1640 |
| 789239 | 240 | 259 | 4691 | 4710 | $A_{es}A_{eo}T_{es}G_{es}A_{es}A_{ds}T_{ds}T_{ds}{}^mC_{ds}{}^mC_{ds}T_{ds}T_{ds}T_{ds}A_{ds}{}^mC_{ds}A_{eo}{}^mC_{eo}{}^mC_{es}A_{es}{}^mC_e$ | 1641 |
| 789240 | N/A | N/A | 29457 | 29476 | $T_{es}T_{eo}T_{es}T_{es}G_{ds}T_{ds}T_{ds}A_{ds}A_{ds}T_{ds}A_{ds}G_{ds}T_{ds}T_{ds}{}^mC_{eo}T_{eo}{}^mC_{es}T_{es}G_e$ | 1904 |
| 789241 | N/A | N/A | 4686 | 4705 | $A_{es}T_{eo}T_{es}{}^mC_{es}{}^mC_{es}T_{ds}T_{ds}T_{ds}A_{ds}{}^mC_{ds}A_{ds}{}^mC_{ds}{}^mC_{ds}A_{ds}{}^mC_{ds}A_{eo}{}^mC_{eo}T_{es}G_{es}G_e$ | 1682 |
| 789242 | 237 | 256 | 4688 | 4707 | $G_{es}A_{eo}A_{es}T_{es}T_{es}{}^mC_{ds}{}^mC_{ds}T_{ds}T_{ds}T_{ds}A_{ds}{}^mC_{ds}A_{ds}{}^mC_{ds}{}^mC_{ds}A_{eo}{}^mC_{eo}A_{es}{}^mC_{es}T_e$ | 1638 |
| 789243 | 238 | 257 | 4689 | 4708 | $T_{es}G_{eo}A_{es}A_{es}T_{es}T_{ds}{}^mC_{ds}{}^mC_{ds}T_{ds}T_{ds}T_{ds}A_{ds}{}^mC_{ds}A_{ds}{}^mC_{ds}{}^mC_{es}A_{eo}{}^mC_{es}A_{es}{}^mC_e$ | 1639 |
| 789244 | 239 | 258 | 4690 | 4709 | $A_{es}T_{eo}G_{es}A_{es}A_{es}T_{ds}T_{ds}{}^mC_{ds}{}^mC_{ds}T_{ds}T_{ds}T_{ds}A_{ds}{}^mC_{ds}A_{ds}{}^mC_{es}{}^mC_{eo}A_{es}{}^mC_{es}A_e$ | 1640 |
| 789245 | 240 | 259 | 4691 | 4710 | $A_{es}A_{eo}T_{es}G_{es}A_{es}A_{ds}T_{ds}T_{ds}{}^mC_{ds}{}^mC_{ds}T_{ds}T_{ds}T_{ds}A_{ds}{}^mC_{ds}A_{es}{}^mC_{eo}{}^mC_{es}A_{es}{}^mC_e$ | 1641 |
| 789246 | N/A | N/A | 29457 | 29476 | $T_{es}T_{eo}T_{es}T_{es}T_{es}G_{ds}T_{ds}T_{ds}A_{ds}A_{ds}T_{ds}A_{ds}G_{ds}T_{ds}T_{ds}{}^mC_{es}T_{eo}{}^mC_{es}T_{es}G_e$ | 1904 |
| 806693 | N/A | N/A | 29458 | 29477 | $T_{es}T_{eo}T_{es}T_{es}T_{es}T_{ds}G_{ds}T_{ds}T_{ds}A_{ds}A_{ds}T_{ds}A_{ds}G_{ds}T_{ds}T_{eo}{}^mC_{eo}T_{es}{}^mC_{es}T_e$ | 2791 |
| 806694 | N/A | N/A | 29459 | 29478 | $T_{es}T_{eo}T_{es}T_{es}T_{es}T_{ds}T_{ds}G_{ds}T_{ds}T_{ds}A_{ds}A_{ds}T_{ds}A_{ds}G_{ds}T_{eo}T_{eo}{}^mC_{es}T_{es}{}^mC_e$ | 2792 |
| 806695 | N/A | N/A | 29460 | 29479 | $A_{es}T_{eo}T_{es}T_{es}T_{es}T_{ds}T_{ds}T_{ds}G_{ds}T_{ds}T_{ds}A_{ds}A_{ds}T_{ds}A_{ds}G_{eo}T_{eo}T_{es}{}^mC_{es}T_e$ | 2793 |
| 806696 | N/A | N/A | 29454 | 29473 | $T_{es}T_{eo}G_{es}T_{es}T_{es}A_{ds}A_{ds}T_{ds}A_{ds}G_{ds}T_{ds}T_{ds}{}^mC_{ds}T_{ds}{}^mC_{es}T_{es}G_{eo}T_{es}T_{es}T_e$ | 1901 |
| 806697 | N/A | N/A | 29455 | 29474 | $T_{es}T_{eo}T_{es}G_{es}T_{es}T_{ds}A_{ds}A_{ds}T_{ds}A_{ds}G_{ds}T_{ds}T_{ds}{}^mC_{ds}T_{ds}{}^mC_{es}T_{eo}G_{es}T_{es}T_e$ | 1902 |
| 806698 | N/A | N/A | 29456 | 29475 | $T_{es}T_{eo}T_{es}T_{es}G_{ds}T_{ds}T_{ds}A_{ds}A_{ds}T_{ds}A_{ds}G_{ds}T_{ds}T_{ds}{}^mC_{ds}T_{es}{}^mC_{eo}T_{es}G_{es}T_e$ | 1903 |
| 806699 | N/A | N/A | 29458 | 29477 | $T_{es}T_{eo}T_{es}T_{es}T_{es}T_{ds}G_{ds}T_{ds}T_{ds}A_{ds}A_{ds}T_{ds}A_{ds}G_{ds}T_{ds}T_{es}{}^mC_{eo}T_{es}{}^mC_{es}T_e$ | 2791 |
| 806700 | N/A | N/A | 29459 | 29478 | $T_{es}T_{eo}T_{es}T_{es}T_{es}T_{ds}T_{ds}G_{ds}T_{ds}T_{ds}A_{ds}A_{ds}T_{ds}A_{ds}G_{ds}T_{es}T_{eo}{}^mC_{es}T_{es}{}^mC_e$ | 2792 |
| 806701 | N/A | N/A | 29460 | 29479 | $A_{es}T_{eo}T_{es}T_{es}T_{es}T_{ds}T_{ds}T_{ds}G_{ds}T_{ds}T_{ds}A_{ds}A_{ds}T_{ds}A_{ds}G_{es}T_{eo}T_{es}{}^mC_{es}T_e$ | 2793 |

TABLE 45-continued

Modified oligonucleotides complementary to human SNCA mRNA

| Compound No | SEQ ID No: 2 start | SEQ ID No: 2 stop | SEQ ID No: 5 start | SEQ ID No: 5 stop | Sequence and chemical notation (5' to 3') | SEQ ID NO: |
|---|---|---|---|---|---|---|
| 806708 | N/A | N/A | 29454 | 29473 | $T_{es}T_{eo}G_{eo}T_{es}T_{es}A_{ds}A_{ds}T_{ds}A_{ds}G_{ds}T_{ds}T_{ds}{}^mC_{ds}T_{ds}{}^mC_{ds}T_{eo}G_{eo}T_{es}T_{es}T_e$ | 1901 |
| 806709 | N/A | N/A | 29455 | 29474 | $T_{es}T_{eo}T_{eo}G_{es}T_{es}T_{ds}A_{ds}A_{ds}T_{ds}A_{ds}G_{ds}T_{ds}T_{ds}{}^mC_{ds}T_{ds}{}^mC_{eo}T_{eo}G_{es}T_{es}T_e$ | 1902 |
| 806710 | N/A | N/A | 29456 | 29475 | $T_{es}T_{eo}T_{eo}T_{es}G_{es}T_{ds}T_{ds}A_{ds}A_{ds}T_{ds}A_{ds}G_{ds}T_{ds}T_{ds}{}^mC_{ds}T_{eo}{}^mC_{eo}T_{es}G_{es}T_e$ | 1903 |
| 806711 | N/A | N/A | 29458 | 29477 | $T_{es}T_{eo}T_{eo}T_{es}T_{es}T_{ds}G_{ds}T_{ds}T_{ds}A_{ds}A_{ds}T_{ds}A_{ds}G_{ds}T_{ds}T_{eo}{}^mC_{eo}T_{es}{}^mC_{es}T_e$ | 2791 |
| 806712 | N/A | N/A | 29459 | 29478 | $T_{es}T_{eo}T_{eo}T_{es}T_{es}T_{ds}T_{ds}G_{ds}T_{ds}T_{ds}A_{ds}A_{ds}T_{ds}A_{ds}G_{ds}T_{eo}T_{eo}{}^mC_{es}T_{es}{}^mC_e$ | 2792 |
| 806713 | N/A | N/A | 29460 | 29479 | $A_{es}T_{eo}T_{eo}T_{es}T_{es}T_{ds}T_{ds}T_{ds}G_{ds}T_{ds}T_{ds}A_{ds}A_{ds}T_{ds}A_{ds}G_{eo}T_{eo}T_{es}{}^mC_{es}T_e$ | 2793 |
| 806714 | N/A | N/A | 29454 | 29473 | $T_{es}T_{eo}G_{es}T_{es}T_{es}A_{ds}A_{ds}T_{ds}A_{ds}G_{ds}T_{ds}T_{ds}{}^mC_{ds}T_{ds}{}^mC_{ds}T_{eo}G_{eo}T_{es}T_{es}T_e$ | 1901 |
| 806715 | N/A | N/A | 29455 | 29474 | $T_{es}T_{eo}T_{es}G_{es}T_{es}T_{ds}A_{ds}A_{ds}T_{ds}A_{ds}G_{ds}T_{ds}T_{ds}{}^mC_{ds}T_{ds}{}^mC_{eo}T_{eo}G_{es}T_{es}T_e$ | 1902 |
| 806716 | N/A | N/A | 29456 | 29475 | $T_{es}T_{eo}T_{es}T_{es}G_{es}T_{ds}T_{ds}A_{ds}A_{ds}T_{ds}A_{ds}G_{ds}T_{ds}T_{ds}{}^mC_{ds}T_{eo}{}^mC_{eo}T_{es}G_{es}T_e$ | 1903 |
| 827592 | N/A | N/A | 19633 | 19652 | $A_{es}{}^mC_{eo}A_{eo}G_{es}A_{es}T_{ds}A_{ds}T_{ds}T_{ds}T_{ds}T_{ds}T_{ds}G_{ds}T_{ds}T_{ds}{}^mC_{eo}T_{eo}G_{es}{}^mC_{es}{}^mC_e$ | 1703 |
| 827599 | N/A | N/A | 19633 | 19652 | $A_{es}{}^mC_{eo}A_{es}G_{es}A_{es}T_{ds}A_{ds}T_{ds}T_{ds}T_{ds}T_{ds}T_{ds}G_{ds}T_{ds}T_{ds}{}^mC_{eo}T_{eo}G_{es}{}^mC_{es}{}^mC_e$ | 1703 |
| 827606 | N/A | N/A | 19633 | 19652 | $A_{es}{}^mC_{eo}A_{es}G_{es}A_{es}T_{ds}A_{ds}T_{ds}T_{ds}T_{ds}T_{ds}T_{ds}G_{ds}T_{ds}T_{ds}{}^mC_{es}T_{eo}G_{es}{}^mC_{es}{}^mC_e$ | 1703 |
| 827607 | N/A | N/A | 21224 | 21243 | $G_{es}T_{eo}T_{es}G_{es}T_{es}T_{ds}{}^mC_{ds}A_{ds}G_{ds}A_{ds}A_{ds}T_{ds}T_{ds}A_{ds}T_{ds}G_{eo}T_{eo}{}^mC_{es}A_{es}T_e$ | 1754 |
| 827611 | N/A | N/A | 23286 | 23305 | ${}^mC_{es}A_{eo}T_{es}A_{es}T_{es}T_{ds}G_{ds}T_{ds}T_{ds}{}^mC_{ds}T_{ds}{}^mC_{ds}A_{ds}G_{ds}A_{ds}G_{eo}A_{eo}{}^mC_{es}{}^mC_{es}A_e$ | 1804 |
| 827617 | N/A | N/A | 28456 | 28475 | ${}^mC_{es}A_{eo}G_{es}A_{es}{}^mC_{es}T_{ds}G_{ds}T_{ds}A_{ds}A_{ds}A_{ds}T_{ds}{}^mC_{ds}T_{ds}A_{ds}G_{ds}G_{eo}A_{eo}{}^mC_{es}{}^mC_{es}{}^mC_e$ | 1887 |
| 827630 | N/A | N/A | 50920 | 50939 | $G_{es}T_{eo}T_{es}T_{es}T_{es}{}^mC_{ds}A_{ds}T_{ds}{}^mC_{ds}A_{ds}A_{ds}A_{ds}T_{ds}A_{ds}T_{ds}{}^mC_{ds}T_{eo}G_{eo}{}^mC_{es}A_{es}A_e$ | 2193 |
| 827649 | N/A | N/A | 21224 | 21243 | $G_{es}T_{eo}T_{es}G_{es}T_{es}T_{ds}{}^mC_{ds}A_{ds}G_{ds}A_{ds}A_{ds}T_{ds}T_{ds}A_{ds}T_{ds}G_{es}T_{eo}{}^mC_{es}A_{es}T_e$ | 1754 |
| 827653 | N/A | N/A | 23286 | 23305 | ${}^mC_{es}A_{eo}T_{es}A_{es}T_{es}T_{ds}G_{ds}T_{ds}T_{ds}{}^mC_{ds}T_{ds}{}^mC_{ds}A_{ds}G_{ds}A_{ds}G_{es}A_{eo}{}^mC_{es}{}^mC_{es}A_e$ | 1804 |
| 827691 | N/A | N/A | 21224 | 21243 | $G_{es}T_{eo}T_{eo}G_{es}T_{es}T_{ds}{}^mC_{ds}A_{ds}G_{ds}A_{ds}A_{ds}T_{ds}T_{ds}A_{ds}T_{ds}G_{eo}T_{eo}{}^mC_{es}A_{es}T_e$ | 1754 |
| 827695 | N/A | N/A | 23286 | 23305 | ${}^mC_{es}A_{eo}T_{eo}A_{es}T_{es}T_{ds}G_{ds}T_{ds}T_{ds}{}^mC_{ds}T_{ds}{}^mC_{ds}A_{ds}G_{ds}A_{ds}G_{eo}A_{eo}{}^mC_{es}{}^mC_{es}A_e$ | 1804 |
| 827701 | N/A | N/A | 28456 | 28475 | ${}^mC_{es}A_{eo}G_{eo}A_{es}{}^mC_{es}T_{ds}G_{ds}T_{ds}A_{ds}A_{ds}A_{ds}T_{ds}{}^mC_{ds}T_{ds}A_{ds}G_{ds}G_{eo}A_{eo}{}^mC_{es}{}^mC_{es}{}^mC_e$ | 1887 |
| 827714 | N/A | N/A | 50920 | 50939 | $G_{es}T_{eo}T_{eo}T_{es}T_{es}{}^mC_{ds}A_{ds}T_{ds}{}^mC_{ds}A_{ds}A_{ds}A_{ds}T_{ds}A_{ds}T_{ds}{}^mC_{ds}T_{eo}G_{eo}{}^mC_{es}A_{es}A_e$ | 2193 |

Example 7: Effect of Modified Oligonucleotides on Human SNCA In Vitro, Multiple Doses Modified oligonucleotides selected from the examples above were tested at various doses in SH-SY5Y cells. Comparator oligonucleotide 387978 was also tested. Cells were plated at a density of 20,000 cells per well and transfected using electroporation with 0.55 μM, 1.67 μM, 5.00 μM and 15.00 μM concentrations of modified oligonucleotide, as specified in the tables below. After a treatment period of approximately 24 hours, total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA, relative to untreated control. A value of 0% reduction indicates that the compound had no effect or increased mRNA concentrations in the cell. As illustrated in the tables below, SNCA mRNA levels were reduced in a dose-dependent manner in modified oligonucleotide-treated cells. $IC_{50}$ was calculated using the "log(inhibitor) vs. response—variable slope (4 parameters)" formula using Prism6 software.

TABLE 46

Dose-dependent percent reduction of human SNCA mRNA by modified oligonucleotides

| Compound Number | SNCA inhibition (% reduction) | | | | $IC_{50}$ ($\mu M$) |
| --- | --- | --- | --- | --- | --- |
| | 0.55 $\mu M$ | 1.67 $\mu M$ | 5.00 $\mu M$ | 15.00 $\mu M$ | |
| 387978 | 20 | 44 | 50 | 75 | 3.49 |
| 709533 | 19 | 51 | 59 | 87 | 2.27 |
| 709551 | 20 | 41 | 61 | 75 | 2.97 |
| 709556 | 16 | 30 | 62 | 82 | 3.34 |
| 709654 | 16 | 47 | 64 | 83 | 2.42 |
| 709581 | 12 | 31 | 61 | 83 | 3.41 |
| 709582 | 10 | 34 | 57 | 76 | 3.86 |
| 709640 | 3 | 22 | 54 | 80 | 4.62 |
| 709875 | 22 | 45 | 58 | 82 | 2.60 |
| 709882 | 33 | 41 | 50 | 86 | 2.57 |
| 709893 | 43 | 70 | 87 | 92 | 0.72 |
| 709900 | 28 | 50 | 58 | 75 | 2.31 |
| 709919 | 26 | 55 | 52 | 88 | 2.07 |
| 709924 | 12 | 36 | 56 | 76 | 3.77 |
| 709936 | 16 | 39 | 60 | 80 | 3.06 |
| 709944 | 42 | 72 | 81 | 90 | 0.71 |
| 709949 | 23 | 35 | 55 | 84 | 3.16 |
| 709967 | 35 | 65 | 62 | 81 | 1.17 |
| 709979 | 30 | 56 | 67 | 76 | 1.62 |

TABLE 47

Dose-dependent percent reduction of human SNCA mRNA by modified oligonucleotides

| Compound Number | SNCA inhibition (% reduction) | | | | $IC_{50}$ ($\mu M$) |
| --- | --- | --- | --- | --- | --- |
| | 0.55 $\mu M$ | 1.67 $\mu M$ | 5.00 $\mu M$ | 15.00 $\mu M$ | |
| 387978 | 14 | 19 | 57 | 76 | 4.58 |
| 709543 | 15 | 37 | 61 | 75 | 3.35 |
| 709544 | 33 | 47 | 71 | 87 | 1.61 |
| 709550 | 33 | 51 | 53 | 78 | 2.12 |
| 709573 | 26 | 48 | 64 | 82 | 2.08 |
| 709579 | 0 | 29 | 67 | 90 | 3.19 |
| 709580 | 19 | 8 | 58 | 86 | 4.49 |
| 709856 | 0 | 21 | 48 | 62 | 7.15 |
| 709592 | 1 | 24 | 51 | 73 | 5.29 |
| 709597 | 7 | 40 | 62 | 86 | 2.96 |
| 709651 | 17 | 26 | 45 | 71 | 5.65 |
| 709873 | 7 | 24 | 74 | 73 | 3.40 |
| 709891 | 19 | 40 | 62 | 80 | 2.82 |
| 709892 | 19 | 33 | 67 | 77 | 3.01 |
| 709897 | 27 | 40 | 55 | 86 | 2.67 |
| 709898 | 32 | 64 | 87 | 90 | 1.04 |
| 709909 | 0 | 23 | 59 | 72 | 4.70 |
| 709953 | 0 | 34 | 55 | 75 | 4.29 |
| 709966 | 23 | 56 | 78 | 87 | 1.51 |

TABLE 48

Dose-dependent percent reduction of human SNCA mRNA by modified oligonucleotides

| Compound Number | SNCA inhibition (% reduction) | | | | $IC_{50}$ ($\mu M$) |
| --- | --- | --- | --- | --- | --- |
| | 0.55 $\mu M$ | 1.67 $\mu M$ | 5.00 $\mu M$ | 15.00 $\mu M$ | |
| 387978 | 6 | 42 | 65 | 72 | 3.23 |
| 709536 | 50 | 68 | 83 | 86 | <0.55 |
| 709548 | 18 | 37 | 59 | 76 | 3.33 |
| 709549 | 41 | 66 | 82 | 89 | 0.81 |
| 709555 | 20 | 45 | 53 | 58 | 4.93 |
| 709560 | 5 | 37 | 60 | 66 | 4.28 |
| 709572 | 43 | 54 | 64 | 79 | 1.12 |
| 709578 | 16 | 37 | 56 | 79 | 3.44 |
| 709591 | 0 | 23 | 50 | 86 | 4.64 |
| 709596 | 0 | 19 | 51 | 70 | 5.83 |
| 709632 | 14 | 39 | 65 | 77 | 2.97 |
| 709668 | 0 | 0 | 8 | 27 | 29.96 |
| 709788 | 0 | 12 | 40 | 72 | 7.11 |
| 709878 | 26 | 71 | 78 | 93 | 1.09 |
| 709879 | 17 | 50 | 84 | 93 | 1.66 |
| 709890 | 41 | 53 | 72 | 87 | 1.13 |
| 709915 | 37 | 64 | 65 | 86 | 1.07 |
| 709940 | 14 | 36 | 67 | 84 | 2.80 |
| 709977 | 37 | 34 | 49 | 68 | 4.04 |

TABLE 49

Dose-dependent percent reduction of human SNCA mRNA by modified oligonucleotides

| Compound Number | SNCA inhibition (% reduction) | | | | $IC_{50}$ ($\mu M$) |
| --- | --- | --- | --- | --- | --- |
| | 0.55 $\mu M$ | 1.67 $\mu M$ | 5.00 $\mu M$ | 15.00 $\mu M$ | |
| 387978 | 11 | 30 | 62 | 72 | 3.92 |
| 709534 | 23 | 48 | 67 | 81 | 2.11 |
| 709535 | 44 | 80 | 74 | 79 | <0.55 |
| 709547 | 37 | 55 | 61 | 83 | 1.42 |
| 709558 | 27 | 56 | 56 | 56 | 3.29 |
| 709563 | 12 | 49 | 64 | 77 | 2.61 |
| 709565 | 25 | 60 | 68 | 78 | 1.62 |
| 709571 | 9 | 47 | 59 | 69 | 3.45 |
| 709576 | 12 | 37 | 69 | 68 | 3.28 |
| 709588 | 9 | 53 | 84 | 84 | 1.73 |
| 709625 | 0 | 24 | 47 | 76 | 5.44 |
| 709727 | 0 | 34 | 49 | 71 | 5.14 |
| 709751 | 0 | 8 | 27 | 57 | 11.73 |
| 709877 | 27 | 52 | 75 | 88 | 1.56 |
| 709881 | 18 | 29 | 58 | 72 | 4.10 |
| 709883 | 21 | 56 | 76 | 83 | 1.63 |
| 709894 | 25 | 37 | 76 | 90 | 2.08 |
| 709895 | 24 | 49 | 77 | 91 | 1.67 |
| 709912 | 4 | 36 | 54 | 73 | 4.32 |

Example 8: Effect of Modified Oligonucleotides on Human SNCA In Vitro, Multiple Doses Modified oligonucleotides selected from the examples above were tested at various doses in SH-SY5Y cells. Cells were plated at a density of 20,000 cells per well and transfected using electroporation with 0.48 $\mu M$, 1.44 $\mu M$, 4.33 $\mu M$, and 13.00 $\mu M$ concentrations of modified oligonucleotide, as specified in the tables below. After a treatment period of approximately 24 hours, total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA, relative to untreated control. A value of 0% reduction indicates that the compound had no effect or increased mRNA concentrations in the cell. As illustrated in the tables below, SNCA mRNA levels were reduced in a dose-dependent manner in modified oligonucleotide-treated cells.

TABLE 50

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.48 μM | 1.44 μM | 4.33 μM | 13.00 μM | |
| 740363 | 7 | 37 | 64 | 89 | 2.53 |
| 740364 | 28 | 35 | 63 | 83 | 2.3 |
| 740406 | 45 | 66 | 85 | 83 | 0.59 |
| 740407 | 46 | 79 | 84 | 93 | 0.51 |
| 740408 | 68 | 81 | 93 | 95 | <0.48 |
| 740409 | 49 | 70 | 92 | 93 | 0.52 |
| 740410 | 43 | 70 | 80 | 90 | 0.62 |
| 740411 | 19 | 63 | 86 | 91 | 1.14 |
| 740412 | 31 | 68 | 75 | 93 | 0.92 |
| 740416 | 41 | 63 | 84 | 94 | 0.74 |
| 740422 | 51 | 69 | 86 | 86 | 0.43 |
| 740425 | 62 | 75 | 78 | 93 | n/a |
| 740427 | 45 | 75 | 87 | 63 | <0.48 |
| 740429 | 33 | 56 | 72 | 86 | 1.16 |
| 740430 | 42 | 70 | 90 | 95 | 0.65 |
| 740432 | 0 | 0 | 0 | 17 | >13 |
| 740438 | 32 | 54 | 67 | 89 | 1.29 |
| 740439 | 39 | 61 | 79 | 96 | 0.84 |
| 740440 | 36 | 55 | 79 | 94 | 1.01 |

TABLE 51

Dose-dependent percent reduction of human SNCA mRNA by modified oligonucleotides

| Compound Number | SNCA Inhibition (% reduction) | | | | IC$_{50}$ (μM) |
|---|---|---|---|---|---|
| | 0.48 μM | 1.44 μM | 4.33 μM | 13.00 μM | |
| 740410 | 43 | 59 | 76 | 68 | 0.68 |
| 740414 | 29 | 44 | 69 | 71 | 1.91 |
| 740431 | 51 | 63 | 68 | 72 | <0.48 |
| 740456 | 39 | 51 | 47 | 70 | 2.02 |
| 740482 | 30 | 44 | 63 | 70 | 2.14 |
| 740498 | 47 | 45 | 68 | 74 | 1.02 |
| 740500 | 46 | 53 | 79 | 78 | 0.74 |
| 740508 | 10 | 38 | 55 | 70 | 3.63 |
| 740509 | 44 | 67 | 80 | 85 | 0.6 |
| 740510 | 24 | 54 | 69 | 83 | 1.56 |
| 740513 | 19 | 35 | 66 | 44 | 6.31 |
| 740517 | 5 | 38 | 73 | 61 | 3.07 |
| 740527 | 0 | 47 | 65 | 80 | 2.43 |
| 740528 | 11 | 45 | 77 | 83 | 1.88 |
| 740533 | 12 | 29 | 76 | 81 | 2.43 |
| 740534 | 21 | 56 | 40 | 5 | n/a |
| 740535 | 7 | 37 | 24 | 62 | 9.22 |
| 740545 | 32 | 58 | 69 | 81 | 1.2 |
| 740612 | 0 | 16 | 69 | 65 | 4.02 |

TABLE 52

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.48 μM | 1.44 μM | 4.33 μM | 13.00 μM | |
| 740140 | 45 | 58 | 69 | 82 | 0.75 |
| 740585 | 19 | 46 | 66 | 62 | 2.70 |
| 740601 | 15 | 47 | 61 | 63 | 3.05 |
| 740604 | 16 | 34 | 45 | 62 | 5.64 |
| 740608 | 2 | 15 | 59 | 63 | 5.13 |
| 740610 | 8 | 43 | 58 | 56 | 4.49 |
| 740615 | 32 | 50 | 59 | 76 | 1.81 |
| 740625 | 7 | 33 | 49 | 78 | 3.88 |
| 740649 | 7 | 25 | 54 | 41 | 11.78 |
| 740650 | 25 | 34 | 54 | 66 | 3.80 |
| 740654 | 27 | 32 | 50 | 75 | 3.45 |
| 740668 | 36 | 41 | 53 | 44 | >13 |
| 740670 | 0 | 40 | 45 | 32 | >13 |
| 740692 | 21 | 28 | 52 | 65 | 4.64 |
| 740730 | 42 | 47 | 62 | 78 | 1.30 |
| 740783 | 36 | 48 | 48 | 74 | 2.23 |
| 740794 | 33 | 35 | 53 | 37 | >13 |
| 740801 | 10 | 38 | 58 | 67 | 3.62 |
| 740802 | 19 | 12 | 55 | 63 | 5.73 |

TABLE 53

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.48 μM | 1.44 μM | 4.33 μM | 13.00 μM | |
| 740140 | 41 | 52 | 71 | 68 | 1.04 |
| 740796 | 3 | 28 | 51 | 54 | 6.89 |
| 740808 | 9 | 32 | 47 | 73 | 4.40 |
| 740851 | 2 | 21 | 46 | 74 | 5.05 |
| 740893 | 4 | 24 | 63 | 72 | 3.71 |
| 740894 | 0 | 20 | 46 | 33 | >13 |
| 740904 | 6 | 19 | 51 | 72 | 4.81 |
| 740919 | 23 | 43 | 68 | 90 | 1.84 |
| 740922 | 0 | 23 | 49 | 63 | 5.89 |
| 740923 | 0 | 29 | 52 | 79 | 3.93 |
| 740927 | 8 | 29 | 58 | 82 | 3.30 |
| 740976 | 16 | 44 | 65 | 72 | 2.52 |
| 740997 | 0 | 26 | 61 | 74 | 3.69 |
| 741000 | 25 | 52 | 43 | 68 | 3.43 |
| 741001 | 34 | 52 | 65 | 78 | 1.41 |
| 741002 | 14 | 37 | 62 | 69 | 3.19 |
| 741005 | 6 | 19 | 45 | 65 | 6.14 |
| 741006 | 54 | 76 | 71 | 78 | <0.48 |
| 741008 | 42 | 54 | 72 | 80 | 0.92 |

TABLE 54

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.48 μM | 1.44 μM | 4.33 μM | 13.00 μM | |
| 740140 | 35 | 60 | 71 | 81 | 1.03 |
| 740939 | 13 | 28 | 60 | 80 | 3.21 |
| 740941 | 8 | 30 | 38 | 83 | 4.55 |
| 740972 | 0 | 29 | 64 | 73 | 3.43 |
| 741009 | 0 | 32 | 52 | 83 | 3.62 |
| 741321 | 59 | 69 | 79 | 89 | <0.48 |
| 741378 | 21 | 49 | 84 | 86 | 1.43 |
| 741410 | 57 | 79 | 85 | 92 | <0.48 |
| 741455 | 53 | 69 | 88 | 87 | <0.48 |
| 741472 | 11 | 40 | 61 | 60 | 3.83 |
| 741473 | 9 | 29 | 53 | 65 | 4.76 |
| 741477 | 32 | 32 | 50 | 49 | 10.65 |
| 741483 | 11 | 23 | 53 | 62 | 5.42 |

TABLE 54-continued

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.48 μM | 1.44 μM | 4.33 μM | 13.00 μM | |
| 741487 | 19 | 39 | 72 | 70 | 2.36 |
| 741502 | 14 | 26 | 51 | 61 | 5.58 |
| 741514 | 0 | 27 | 41 | 73 | 5.34 |
| 741516 | 8 | 13 | 63 | 70 | 4.29 |
| 741525 | 9 | 32 | 58 | 61 | 4.70 |
| 741540 | 0 | 25 | 41 | 26 | <0.48 |

Example 9: Effect of Modified Oligonucleotides on Human SNCA In Vitro, Multiple Doses Modified oligonucleotides selected from the examples above were tested at various doses in SH-SY5Y cells. Comparator oligonucleotide 397978 was also tested. Cells were plated at a density of 20,000 cells per well and transfected using electroporation with 0.11 μM, 0.33 μM, 1.00 μM, and 3.00 μM concentrations of modified oligonucleotide, as specified in the tables below. After a treatment period of approximately 24 hours, total RNA was isolated from the cells and SNCA mRNA levels were measured by quantitative real-time PCR. Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA, relative to untreated control. A value of 0% reduction indicates that the compound had no effect or increased mRNA concentrations in the cell. As illustrated in the tables below, SNCA mRNA levels were reduced in a dose-dependent manner in modified oligonucleotide-treated cells.

TABLE 55

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.11 μM | 0.33 μM | 1.00 μM | 3.00 μM | |
| 740140 | 16 | 43 | 62 | 90 | 0.51 |
| 741021 | 19 | 56 | 81 | 93 | 0.30 |
| 741022 | 28 | 62 | 83 | 87 | 0.24 |
| 741028 | 28 | 54 | 78 | 94 | 0.28 |
| 741029 | 36 | 57 | 87 | 83 | 0.22 |
| 741032 | 23 | 56 | 86 | 93 | 0.28 |
| 741037 | 26 | 64 | 88 | 89 | 0.23 |
| 741077 | 34 | 53 | 84 | 89 | 0.24 |
| 741122 | 30 | 69 | 88 | 87 | 0.20 |
| 741125 | 25 | 57 | 83 | 91 | 0.27 |
| 741169 | 34 | 66 | 94 | 96 | 0.19 |
| 741170 | 34 | 71 | 92 | 93 | 0.18 |
| 741189 | 35 | 56 | 81 | 95 | 0.23 |
| 741206 | 32 | 57 | 81 | 94 | 0.24 |
| 741207 | 26 | 63 | 91 | 96 | 0.23 |
| 741228 | 23 | 49 | 78 | 90 | 0.34 |
| 741229 | 10 | 58 | 81 | 95 | 0.31 |
| 741278 | 28 | 49 | 76 | 92 | 0.31 |
| 741379 | 22 | 70 | 86 | 93 | 0.22 |

TABLE 56

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.11 μM | 0.33 μM | 1.00 μM | 3.00 μM | |
| 740140 | 13 | 38 | 70 | 87 | 0.50 |
| 741016 | 30 | 42 | 74 | 91 | 0.36 |
| 741018 | 10 | 32 | 65 | 88 | 0.61 |
| 741019 | 14 | 20 | 56 | 86 | 0.82 |
| 741030 | 17 | 27 | 64 | 89 | 0.63 |
| 741034 | 12 | 28 | 47 | 80 | 0.93 |
| 741038 | 14 | 42 | 72 | 91 | 0.46 |
| 741039 | 63 | 42 | 70 | 93 | 0.11 |
| 741043 | 13 | 33 | 66 | 83 | 0.60 |
| 741047 | 29 | 45 | 72 | 94 | 0.35 |
| 741049 | 18 | 34 | 58 | 84 | 0.65 |
| 741073 | 4 | 46 | 75 | 93 | 0.43 |
| 741078 | 23 | 52 | 72 | 92 | 0.33 |
| 741080 | 15 | 37 | 66 | 78 | 0.59 |
| 741082 | 18 | 48 | 75 | 95 | 0.37 |
| 741083 | 17 | 36 | 72 | 82 | 0.51 |
| 741101 | 18 | 44 | 79 | 92 | 0.38 |
| 741111 | 0 | 29 | 68 | 88 | 0.64 |
| 741129 | 5 | 38 | 54 | 77 | 0.79 |

TABLE 57

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.11 μM | 0.33 μM | 1.00 μM | 3.00 μM | |
| 740140 | 39 | 34 | 69 | 81 | 0.39 |
| 741094 | 3 | 13 | 56 | 78 | 0.99 |
| 741110 | 5 | 26 | 47 | 66 | 1.26 |
| 741113 | 27 | 26 | 69 | 76 | 0.60 |
| 741167 | 16 | 37 | 70 | 79 | 0.54 |
| 741168 | 23 | 39 | 63 | 84 | 0.52 |
| 741178 | 29 | 34 | 58 | 77 | 0.62 |
| 741179 | 22 | 54 | 71 | 89 | 0.34 |
| 741188 | 0 | 25 | 70 | 77 | 0.70 |
| 741190 | 18 | 51 | 70 | 78 | 0.41 |
| 741191 | 23 | 37 | 63 | 82 | 0.55 |
| 741195 | 0 | 20 | 58 | 81 | 0.88 |
| 741197 | 20 | 34 | 69 | 76 | 0.58 |
| 741201 | 6 | 25 | 46 | 81 | 1.01 |
| 741205 | 14 | 34 | 66 | 87 | 0.57 |
| 741208 | 13 | 51 | 72 | 82 | 0.42 |
| 741227 | 8 | 30 | 61 | 78 | 0.74 |
| 741230 | 10 | 27 | 45 | 73 | 1.10 |
| 741231 | 0 | 20 | 33 | 82 | 1.31 |

TABLE 58

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.11 μM | 0.33 μM | 1.00 μM | 3.00 μM | |
| 387978 | 11 | 0 | 7 | 39 | >3.0 |
| 740140 | 26 | 35 | 52 | 80 | 0.67 |
| 740432 | 19 | 36 | 53 | 74 | 0.77 |
| 741187 | 18 | 30 | 60 | 78 | 0.72 |
| 741214 | 7 | 18 | 52 | 79 | 1.00 |
| 741220 | 16 | 35 | 49 | 73 | 0.91 |
| 741234 | 20 | 41 | 71 | 85 | 0.45 |
| 741241 | 15 | 25 | 53 | 78 | 0.88 |
| 741246 | 3 | 26 | 54 | 68 | 1.06 |
| 741280 | 21 | 44 | 62 | 78 | 0.52 |

TABLE 58-continued

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.11 µM | 0.33 µM | 1.00 µM | 3.00 µM | |
| 741301 | 22 | 46 | 66 | 84 | 0.44 |
| 741315 | 25 | 46 | 68 | 83 | 0.40 |
| 741320 | 17 | 36 | 65 | 85 | 0.55 |
| 741329 | 24 | 40 | 61 | 82 | 0.53 |
| 741330 | 13 | 36 | 69 | 85 | 0.55 |
| 741335 | 12 | 35 | 60 | 76 | 0.72 |
| 741368 | 18 | 46 | 72 | 87 | 0.42 |
| 741373 | 10 | 31 | 58 | 73 | 0.83 |
| 741393 | 17 | 37 | 67 | 82 | 0.54 |

Example 10: Effect of Modified Oligonucleotides on Human SNCA In Vitro, Multiple Doses Modified oligonucleotides selected from the examples above were tested at various doses in SH-SY5Y cells. Compound No. 387985, previously disclosed in WO 2012/068405 was also tested and is comparator oligonucleotide. Cells were plated at a density of 20,000 cells per well and transfected using electroporation with 0.44 µM, 1.33 µM, 4.00 µM, and 12.00 µM concentrations of modified oligonucleotide, as specified in the tables below. After a treatment period of approximately 24 hours, total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA, relative to untreated control. A value of 0% reduction indicates that the compound had no effect or increased mRNA concentrations in the cell. As illustrated in the tables below, SNCA mRNA levels were reduced in a dose-dependent manner in modified oligonucleotide-treated cells.

TABLE 59

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 42 | 76 | 86 | 93 | 0.56 |
| 741140 | 77 | 74 | 96 | 86 | <0.44 |
| 762851 | 24 | 45 | 76 | 93 | 1.45 |
| 762855 | 16 | 45 | 85 | 90 | 1.46 |
| 762858 | 25 | 55 | 84 | 96 | 1.11 |
| 762880 | 9 | 33 | 55 | 85 | 2.93 |
| 762882 | 75 | 92 | 94 | 90 | 0.07 |
| 762886 | 39 | 67 | 82 | 84 | 0.66 |
| 762891 | 25 | 61 | 88 | 93 | 0.97 |
| 762893 | 31 | 63 | 86 | 95 | 0.87 |
| 762899 | 42 | 74 | 88 | 82 | 0.53 |
| 762900 | 69 | 93 | 96 | 97 | <0.44 |
| 762901 | 63 | 86 | 90 | 93 | <0.44 |
| 762924 | 30 | 59 | 82 | 84 | 0.97 |
| 762926 | 40 | 63 | 80 | 92 | 0.72 |
| 762930 | 37 | 73 | 85 | 80 | 0.62 |
| 762932 | 42 | 72 | 94 | 93 | 0.58 |
| 762953 | 39 | 61 | 85 | 91 | 0.76 |
| 762969 | 60 | 72 | 86 | 92 | <0.44 |

TABLE 60

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 58 | 79 | 70 | 75 | <0.44 |
| 741140 | 84 | 93 | 89 | 79 | >12 |
| 762914 | 80 | 87 | 91 | 95 | <0.44 |
| 762952 | 42 | 74 | 85 | 94 | 0.57 |
| 762960 | 34 | 54 | 79 | 82 | 1.01 |
| 762962 | 52 | 81 | 84 | 94 | <0.44 |
| 762965 | 48 | 72 | 91 | 93 | 0.48 |
| 762987 | 37 | 69 | 86 | 75 | 0.65 |
| 763002 | 37 | 54 | 79 | 88 | 0.94 |
| 763019 | 30 | 51 | 77 | 91 | 1.19 |
| 763032 | 47 | 70 | 84 | 78 | <0.44 |
| 763033 | 68 | 84 | 89 | 86 | <0.44 |
| 763035 | 40 | 69 | 85 | 91 | 0.64 |
| 763040 | 36 | 67 | 85 | 94 | 0.73 |
| 763049 | 34 | 68 | 82 | 88 | 0.77 |
| 763050 | 54 | 87 | 87 | 84 | <0.44 |
| 763052 | 54 | 75 | 85 | 91 | <0.44 |
| 763059 | 4 | 67 | 83 | 89 | 1.08 |
| 763087 | 51 | 93 | 91 | 94 | <0.44 |

TABLE 61

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 48 | 60 | 61 | 75 | n/a |
| 741140 | 80 | 84 | 77 | 93 | n/a |
| 763065 | 22 | 55 | 73 | 89 | 1.32 |
| 763072 | 45 | 66 | 76 | 91 | 0.57 |
| 763075 | 39 | 58 | 86 | 89 | 0.78 |
| 763079 | 49 | 74 | 86 | 83 | <0.44 |
| 763081 | 39 | 69 | 70 | 83 | 0.68 |
| 763084 | 50 | 73 | 75 | 89 | <0.44 |
| 763085 | 57 | 81 | 88 | 83 | <0.44 |
| 763088 | 73 | 72 | 79 | 89 | <0.44 |
| 763102 | 20 | 55 | 77 | 68 | 1.51 |
| 763142 | 58 | 70 | 79 | 87 | <0.44 |
| 763150 | 44 | 60 | 74 | 84 | 0.68 |
| 763151 | 39 | 71 | 68 | 82 | 0.64 |
| 763166 | 52 | 77 | 75 | 84 | <0.44 |
| 763177 | 60 | 64 | 89 | 72 | <0.44 |
| 763182 | 22 | 57 | 67 | 76 | 1.49 |
| 763196 | 52 | 68 | 86 | 83 | <0.44 |
| 763207 | 49 | 73 | 79 | 82 | <0.44 |

TABLE 62

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 48 | 66 | 84 | 82 | 0.45 |
| 741140 | 77 | 88 | 89 | 97 | <0.44 |
| 763145 | 79 | 81 | 74 | 92 | <0.44 |
| 763185 | 31 | 64 | 79 | 86 | 0.90 |
| 763188 | 36 | 70 | 85 | 90 | 0.69 |
| 763216 | 41 | 72 | 68 | 94 | 0.61 |
| 763225 | 54 | 74 | 84 | 93 | <0.44 |
| 763228 | 18 | 53 | 79 | 93 | 1.32 |
| 763233 | 45 | 68 | 83 | 94 | 0.56 |
| 763249 | 25 | 48 | 65 | 89 | 1.56 |

TABLE 62-continued

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 763272 | 38 | 60 | 89 | 95 | 0.77 |
| 763281 | 58 | 74 | 92 | 96 | <0.44 |
| 763291 | 27 | 35 | 67 | 86 | 1.92 |
| 763299 | 52 | 71 | 83 | 87 | <0.44 |
| 763309 | 43 | 43 | 72 | 76 | 1.11 |
| 763312 | 45 | 68 | 82 | 94 | 0.56 |
| 763333 | 12 | 55 | 85 | 81 | 1.32 |
| 763341 | 34 | 61 | 67 | 89 | 0.96 |
| 763364 | 51 | 74 | 72 | 90 | <0.44 |

TABLE 63

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 27 | 47 | 55 | 55 | 3.65 |
| 741140 | 48 | 56 | 56 | 49 | <0.44 |
| 763295 | 22 | 51 | 64 | 71 | 1.88 |
| 763305 | 28 | 52 | 54 | 71 | 2.05 |
| 763348 | 27 | 40 | 51 | 68 | 3.12 |
| 763355 | 43 | 49 | 51 | 62 | 1.77 |
| 763359 | 35 | 57 | 61 | 68 | 1.32 |
| 763360 | 49 | 55 | 71 | 74 | 0.55 |
| 763370 | 18 | 54 | 61 | 75 | 1.93 |
| 763373 | 44 | 45 | 69 | 70 | 1.09 |
| 763384 | 23 | 52 | 40 | 69 | 3.43 |
| 763391 | 28 | 48 | 55 | 66 | 2.49 |
| 763393 | 49 | 36 | 50 | 71 | 1.96 |
| 763394 | 25 | 41 | 71 | 86 | 1.68 |
| 763418 | 0 | 31 | 57 | 41 | 9.00 |
| 763434 | 38 | 66 | 50 | 65 | 1.04 |
| 763440 | 25 | 46 | 49 | 51 | <0.44 |
| 763481 | 34 | 51 | 57 | 69 | 1.74 |
| 763491 | 32 | 47 | 54 | 64 | 2.53 |

TABLE 64

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 47 | 59 | 54 | 50 | <0.44 |
| 741140 | 62 | 58 | 74 | 68 | <0.44 |
| 763466 | 19 | 47 | 55 | 66 | 2.87 |
| 763485 | 34 | 49 | 71 | 70 | 1.33 |
| 763492 | 7 | 44 | 40 | 62 | 5.24 |
| 763501 | 25 | 36 | 59 | 62 | 3.35 |
| 763612 | 33 | 44 | 45 | 71 | 2.76 |
| 763627 | 39 | 62 | 60 | 68 | 0.91 |
| 763628 | 22 | 48 | 42 | 57 | <0.44 |
| 763629 | 31 | 48 | 53 | 76 | 2.00 |
| 763634 | 26 | 41 | 44 | 57 | 5.83 |
| 763640 | 12 | 44 | 31 | 74 | 4.70 |
| 763641 | 6 | 33 | 51 | 76 | 3.58 |
| 763643 | 16 | 32 | 49 | 57 | 5.74 |
| 763645 | 18 | 36 | 55 | 71 | 3.22 |
| 763650 | 45 | 61 | 46 | 65 | 0.83 |
| 763651 | 43 | 60 | 64 | 59 | 0.62 |
| 763671 | 17 | 47 | 43 | 59 | 5.08 |
| 763741 | 23 | 37 | 61 | 71 | 2.64 |

TABLE 65

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 42 | 61 | 84 | 75 | 0.65 |
| 741140 | 72 | 79 | 92 | 94 | <0.44 |
| 762837* | 20 | 37 | 62 | 81 | 2.4 |
| 763684 | 13 | 44 | 75 | 92 | 1.69 |
| 763685 | 27 | 64 | 83 | 90 | 0.95 |
| 763693 | 3 | 15 | 58 | 76 | 3.88 |
| 763701 | 1 | 38 | 74 | 77 | 2.26 |
| 763702 | 16 | 37 | 68 | 84 | 2.15 |
| 763706 | 12 | 48 | 57 | 86 | 2.17 |
| 763712 | 18 | 50 | 56 | 89 | 1.90 |
| 763721 | 1 | 37 | 61 | 60 | 3.90 |
| 763723 | 19 | 42 | 65 | 77 | 2.16 |
| 763734 | 0 | 22 | 56 | 77 | 3.78 |
| 763740 | 32 | 47 | 77 | 88 | 1.23 |
| 763749 | 24 | 61 | 81 | 71 | 1.16 |
| 763755 | 8 | 45 | 57 | 72 | 2.82 |
| 763778 | 25 | 59 | 78 | 76 | 1.18 |
| 763793 | 41 | 71 | 81 | 93 | 0.61 |
| 763823 | 23 | 60 | 82 | 71 | 1.17 |

*Values represent the average of three experiments

TABLE 66

Dose-dependent percent reduction of human SNCA mRNA by modified oligonucleotides in SH-SY5Y cells

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 50 | 59 | 68 | 93 | 0.58 |
| 741140 | 75 | 64 | 83 | 88 | n/a |
| 762837 | 12 | 37 | 64 | 82 | 2.43 |
| 762837 | 27 | 33 | 51 | 86 | 2.64 |
| 763795 | 17 | 42 | 62 | 79 | 2.26 |
| 763798 | 25 | 43 | 63 | 78 | 2.00 |
| 763817 | 10 | 38 | 57 | 88 | 2.55 |
| 763818 | 24 | 53 | 52 | 92 | 1.72 |
| 763829 | 41 | 68 | 66 | 94 | 0.68 |
| 763876 | 33 | 65 | 83 | 84 | 0.81 |
| 763877 | 25 | 49 | 47 | 83 | 2.23 |
| 763882 | 27 | 57 | 67 | 86 | 1.27 |
| 763883 | 44 | 63 | 71 | 92 | 0.67 |
| 763884 | 25 | 42 | 64 | 78 | 2.00 |
| 763936 | 19 | 31 | 56 | 80 | 2.92 |
| 763939 | 18 | 27 | 54 | 65 | 4.27 |
| 763949 | 12 | 28 | 58 | 67 | 3.83 |
| 763972 | 0 | 36 | 46 | 67 | 4.60 |
| 763985 | 6 | 28 | 60 | 65 | 3.86 |

TABLE 67

Dose-dependent percent reduction of human SNCA mRNA by modified oligonucleotides

| Compound Number | SNCA inhibition (% reduction) | | | | IC$_{50}$ (µM) |
|---|---|---|---|---|---|
| | 0.44 µM | 1.33 µM | 4.00 µM | 12.00 µM | |
| 740140 | 41 | 60 | 74 | 82 | 0.73 |
| 741140 | 79 | 89 | 91 | 87 | <0.44 |
| 763295 | 8 | 38 | 77 | 91 | 1.88 |
| 763305 | 19 | 52 | 75 | 89 | 1.41 |
| 763348 | 28 | 62 | 78 | 93 | 0.97 |
| 763355 | 25 | 61 | 86 | 85 | 0.99 |
| 763359 | 49 | 76 | 90 | 94 | 0.45 |
| 763360 | 60 | 86 | 94 | 94 | <0.44 |
| 763370 | 28 | 68 | 89 | 90 | 0.83 |

TABLE 67-continued

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.44 μM | 1.33 μM | 4.00 μM | 12.00 μM | |
| 763373 | 51 | 59 | 79 | 90 | 0.51 |
| 763384 | 37 | 67 | 85 | 92 | 0.70 |
| 763391 | 30 | 64 | 79 | 82 | 0.94 |
| 763393 | 35 | 76 | 84 | 93 | 0.67 |
| 763394 | 36 | 76 | 83 | 96 | 0.65 |
| 763418 | 0 | 26 | 54 | 81 | 3.52 |
| 763434 | 40 | 73 | 91 | 92 | 0.60 |
| 763440 | 15 | 51 | 74 | 83 | 1.57 |
| 763481 | 35 | 73 | 84 | 88 | 0.68 |
| 763491 | 31 | 53 | 80 | 83 | 1.11 |

TABLE 68

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.44 μM | 1.33 μM | 4.00 μM | 12.00 μM | |
| 740140 | 36 | 53 | 69 | 87 | 1.08 |
| 741140 | 60 | 70 | 87 | 88 | <0.44 |
| 763466 | 27 | 52 | 74 | 80 | 1.34 |
| 763485 | 36 | 66 | 80 | 87 | 0.75 |
| 763492 | 9 | 41 | 71 | 87 | 1.97 |
| 763501 | 24 | 48 | 71 | 79 | 1.58 |
| 763612 | 37 | 63 | 82 | 90 | 0.76 |
| 763627 | 41 | 63 | 84 | 82 | 0.66 |
| 763628 | 44 | 72 | 85 | 86 | 0.53 |
| 763629 | 29 | 59 | 80 | 85 | 1.02 |
| 763634 | 22 | 55 | 81 | 92 | 1.18 |
| 763640 | 34 | 48 | 80 | 88 | 1.13 |
| 763641 | 21 | 53 | 79 | 82 | 1.33 |
| 763643 | 35 | 53 | 82 | 82 | 0.97 |
| 763645 | 0 | 55 | 65 | 84 | 1.93 |
| 763650 | 46 | 71 | 81 | 92 | 0.51 |
| 763651 | 40 | 57 | 82 | 86 | 0.79 |
| 763671 | 0 | 31 | 54 | 76 | 3.55 |
| 763741 | 32 | 40 | 71 | 73 | 1.71 |

TABLE 69

Dose-dependent percent reduction of human SNCA mRNA by modified oligonucleotides

| Compound Number | SNCA inhibition (% reduction) | | | | IC$_{50}$ (μM) |
|---|---|---|---|---|---|
| | 0.44 μM | 1.33 μM | 4.00 μM | 12.00 μM | |
| 387985 | 0 | 22 | 48 | 67 | 5.00 |
| 789243 | 9 | 38 | 66 | 79 | 2.40 |
| 827599 | 52 | 71 | 86 | 91 | 0.40 |

Example 11: Effect of Modified Oligonucleotides on Human SNCA In Vitro, Multiple Doses Modified oligonucleotides selected from the examples above were tested at various doses in SH-SY5Y cells. Compound No. 387985, previously disclosed in WO 2012/068405 was also tested and is comparator oligonucleotide. Cells were plated at a density of 20,000 cells per well and transfected using electroporation with 0.032 μM, 0.160 μM, 0.800 μM, 4.000 μM, and 20.000 μM concentrations of modified oligonucleotide, as specified in the tables below. After a treatment period of approximately 24 hours, total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA, relative to untreated control. A value of 0% reduction indicates that the compound had no effect or increased mRNA concentrations in the cell. As illustrated in the tables below, SNCA mRNA levels were reduced in a dose-dependent manner in modified oligonucleotide-treated cells.

TABLE 70

Dose-dependent percent reduction of human SNCA mRNA by modified oligonucleotides

| Compound Number | SNCA inhibition (% reduction) | | | | | IC$_{50}$ (μM) |
|---|---|---|---|---|---|---|
| | 0.032 μM | 0.160 μM | 0.800 μM | 4.000 μM | 20.000 μM | |
| 762837 | 0 | 7 | 33 | 76.1 | 91 | 1.72 |
| 762901 | 8 | 33 | 73 | 91 | 93 | 0.32 |
| 762952 | 0 | 15 | 67 | 81 | 95 | 0.57 |
| 763002 | 0 | 8 | 47 | 75 | 94 | 1.10 |
| 763032 | 11 | 35 | 71 | 77 | 96 | 0.36 |
| 763085 | 0 | 31 | 63 | 83 | 94 | 0.47 |
| 763364 | 0 | 16 | 51 | 81 | 89 | 0.86 |
| 763391 | 0 | 14 | 48 | 71 | 91 | 1.10 |
| 788833 | 0 | 8 | 39 | 77 | 90 | 1.31 |
| 789239 | 0 | 0 | 14 | 61 | 87 | 3.02 |
| 789242 | 0 | 1 | 27 | 60 | 85 | 2.67 |
| 789243 | 0 | 1 | 27 | 64 | 90 | 2.25 |

TABLE 71

Dose-dependent percent reduction of human SNCA mRNA by modified oligonucleotides

| Compound Number | SNCA inhibition (% reduction) | | | | | IC$_{50}$ (μM) |
|---|---|---|---|---|---|---|
| | 0.032 μM | 0.160 μM | 0.800 μM | 4.000 μM | 20.000 μM | |
| 387985 | 0 | 0 | 13 | 54 | 77 | 4.20 |
| 789243 | 0 | 7 | 31 | 69 | 85 | 1.90 |
| 827599 | 10 | 34 | 65 | 84 | 91 | 0.40 |

Example 12: Effect of Modified Oligonucleotides on Human SNCA In Vitro, Multiple Doses Modified oligonucleotides selected from the examples above were tested at various doses in A431 cells. Cells were plated at a density of 5,000 cells per well and transfected by free uptake with 0.032 μM, 0.160 μM, 0.800 μM, 4.000 μM, and 20.000 μM concentrations of modified oligonucleotide, as specified in the tables below. After a treatment period of approximately 24 hours, total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA, relative to untreated control. A value of 0% reduction indicates that the compound had no effect or increased mRNA concentrations in the cell. As illustrated in the tables below, SNCA mRNA levels were reduced in a dose-dependent manner in modified oligonucleotide-treated cells.

TABLE 72

Dose-dependent percent reduction of human SNCA mRNA by modified oligonucleotides

| Compound Number | SNCA inhibition (% reduction) | | | | | IC$_{50}$ (µM) |
|---|---|---|---|---|---|---|
| | 0.032 µM | 0.160 µM | 0.800 µM | 4.000 µM | 20.000 µM | |
| 762837 | 0 | 6 | 7 | 33 | 51 | 16.95 |
| 762901 | 1 | 28 | 53 | 60 | 81 | 1.20 |
| 762952 | 16 | 38 | 59 | 81 | 93 | 0.41 |
| 763002 | 0 | 6 | 41 | 71 | 87 | 1.49 |
| 763032 | 12 | 60 | 89 | 96 | 97 | 0.13 |
| 763085 | 2 | 19 | 75 | 90 | 96 | 0.40 |
| 763364 | 38 | 57 | 77 | 93 | 97 | 0.09 |
| 763391 | 5 | 28 | 71 | 92 | 95 | 0.37 |
| 788833 | 8 | 23 | 53 | 71 | 93 | 0.82 |
| 789239 | 6 | 0 | 32 | 32 | 45 | 0.00 |
| 789242 | 0 | 0 | 4 | 32 | 66 | 9.78 |
| 789243 | 0 | 3 | 13 | 39 | 66 | 8.02 |

Example 13: Effect of Modified Oligonucleotides on Rhesus Monkey SNCA In Vitro, Multiple Doses Several of the modified oligonucleotides described hereinabove are complementary to rhesus monkey Human-monkey cross reactive modified oligonucleotides selected from the examples above were tested at various doses in LLC-MK2 monkey cells. Cells were plated at a density of 20,000 cells per well and transfected using electroporation with 6.9 nM, 20.5 nM, 61.8 nM, 185.2 nM, 500.0 nM, 1700.0 nM, 5000.0 nM, and 15,000.0 nM concentrations of modified oligonucleotide, as specified in the table below. After a treatment period of approximately 24 hours, total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA, relative to untreated control. The half maximal inhibitory concentration (IC$_{50}$) of each oligonucleotide is also presented in the table below. A value of 0% reduction indicates that the compound had no effect or increased mRNA concentrations in the cell. As illustrated in the tables below, SNCA mRNA levels were reduced in a dose-dependent manner in modified oligonucleotide-treated cells.

TABLE 73

Dose-dependent percent reduction of rhesus monkey SNCA mRNA by modified oligonucleotides

| Compound No. | SNCA Inhibition (% Reduction) | | | | | | | | IC$_{50}$ (µM) |
|---|---|---|---|---|---|---|---|---|---|
| | 6.9 nM | 20.5 nM | 61.8 nM | 185.2 nM | 500.0 nM | 1700.0 nM | 5000.0 nM | 15,000.0 nM | |
| 709534 | 0 | 0 | 0 | 0 | 8 | 46 | 66 | 79 | 2.8 |
| 709535 | 0 | 0 | 0 | 7 | 28 | 59 | 84 | 90 | 1.4 |
| 709536 | 0 | 0 | 0 | 16 | 44 | 66 | 78 | 90 | 1.1 |
| 709883 | 0 | 0 | 0 | 0 | 36 | 61 | 76 | 88 | 1.5 |
| 709967 | 0 | 0 | 0 | 0 | 8 | 35 | 73 | 90 | 2.5 |
| 741082* | 0 | 0 | 0 | 0 | 0 | 0 | 36 | 78 | 7.0 |

*one mismatch to rhesus monkey

Example 14: Effect of Modified Oligonucleotides on Monkey SNCA In Vitro, Multiple Doses Several of the modified oligonucleotides described hereinabove are complementary to rhesus monkeys. Human-monkey cross reactive modified oligonucleotides selected from the examples above were tested at various doses in LLC-MK2 monkey cells. Modified oligonucleotides with 1-3 mismatches to rhesus monkey sequence are marked in the table below. Cells were plated at a density of 20,000 cells per well and transfected using electroporation with 0.032 µM, 0.160 µM, 0.800 µM, 4.000 µM, and 20.000 µN concentrations of modified oligonucleotide, as specified in the table below. After a treatment period of approximately 24 hours, total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA, relative to untreated control. As illustrated in the tables below, SNCA mRNA levels were reduced in a dose-dependent manner in modified oligonucleotide-treated cells.

TABLE 74

Dose-dependent percent reduction of rhesus monkey SNCA mRNA by modified oligonucleotides

| Compound Number | SNCA inhibition (% reduction) | | | | | IC$_{50}$ (µM) |
|---|---|---|---|---|---|---|
| | 0.032 µM | 0.160 µM | 0.800 µM | 4.000 µM | 20.000 µM | |
| 762837 | 0 | 0 | 5 | 57 | 84 | 3.67 |
| 762901 | 0 | 18 | 47 | 88 | 98 | 0.80 |
| 762952** | 0 | 0 | 0 | 14 | 53 | 17.90 |
| 763002 | 12 | 0 | 36 | 85 | 93 | 1.23 |
| 763032 | 6 | 29 | 63 | 85 | 94 | 0.47 |
| 763085* | 0 | 0 | 28 | 60 | 81 | 2.75 |
| 763364* | 0 | 0 | 28 | 58 | 85 | 2.77 |
| 763391 | 0 | 3 | 50 | 65 | 87 | 1.46 |
| 788833 | 0 | 0 | 15 | 59 | 84 | 3.30 |
| 789239 | 0 | 0 | 3 | 45 | 78 | 5.61 |
| 789242 | 0 | 0 | 5 | 41 | 78 | 6.05 |
| 789243 | 0 | 0 | 19 | 56 | 85 | 3.28 |

*one mismatch to monkey;
**two mismatches to monkey

Example 15: Effect of Modified Oligonucleotides on Human SNCA in Human Neurons by Free Uptake, Single Dose Selected modified oligonucleotides complementary to human SNCA were tested for their effects on SCNA mRNA levels in human neurons in vitro by free uptake. Human IPS-cell derived neurons were plated at a density of 35,000 cells per well. After approximately 24 hours, 20 μM modified oligonucleotide was added and incubated with the cultured cells for 7 days. After 7 days, total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA relative to untreated control cells. As shown below, modified oligonucleotides complementary to human SNCA reduced the amount of human SNCA mRNA.

TABLE 75

Percent reduction of human SNCA mRNA in human neurons by free uptake

| Compound No | % Reduction |
|---|---|
| 709897 | 53 |
| 740425 | 58 |
| 741082 | 98 |
| 762836 | 80 |
| 762837 | 79 |
| 762838 | 75 |
| 762839 | 64 |
| 762840 | 54 |
| 762895 | 60 |
| 762896 | 63 |
| 762898 | 82 |
| 762899 | 86 |
| 762900 | 85 |
| 762901 | 41 |
| 762914 | 74 |
| 762948 | 33 |
| 762949 | 96 |
| 762951 | 45 |
| 762952 | 77 |
| 763001 | 84 |
| 763002 | 82 |
| 763003 | 86 |
| 763004 | 82 |
| 763032 | 88 |
| 763033 | 82 |
| 763035 | 68 |
| 763040 | 71 |
| 763050 | 78 |
| 763084 | 89 |
| 763085 | 95 |
| 763087 | 78 |
| 763102 | 66 |
| 763196 | 56 |
| 763207 | 90 |
| 763216 | 65 |
| 763233 | 68 |
| 763364 | 83 |
| 763391 | 95 |
| 763393 | 81 |
| 763813 | 57 |
| 763817 | 51 |
| 763818 | 61 |
| 788815 | 63 |
| 788816 | 67 |
| 788820 | 63 |
| 788821 | 69 |
| 788822 | 76 |
| 788823 | 81 |
| 788824 | 73 |
| 788830 | 64 |
| 788831 | 67 |
| 788832 | 73 |
| 788833 | 79 |
| 788855 | 83 |
| 788856 | 85 |
| 788889 | 70 |
| 788890 | 47 |
| 789235 | 36 |
| 789236 | 80 |
| 789237 | 61 |
| 789239 | 56 |
| 789240 | 44 |
| 789242 | 81 |
| 789243 | 77 |
| 789244 | 66 |
| 789245 | 59 |
| 789246 | 46 |

Example 16: Effect of Modified Oligonucleotides on Human SNCA in Human Neurons by Free Uptake, Multiple Dose Selected modified oligonucleotides complementary to human SNCA were tested for their effects on SCNA mRNA levels in human neurons in vitro by free uptake Human IPS-cell derived neurons were plated at a density of 35,000 cells per well and incubated with 247.00 nM, 740.70 nM, 2.22 μM, 6.66 μM, or 20.00 μM oligonucleotide. After a treatment period of 5 days total RNA was isolated from the cells and SNCA mRNA levels were measured by quantitative real-time PCR Human SNCA primer probe set RTS2621 (described hereinabove in Example 1) was used to measure mRNA levels. SNCA mRNA levels were adjusted according to total RNA content, as measured by RIBOGREEN®. Results are presented in the tables below as percent reduction of the amount of SNCA mRNA relative to untreated control cells. A value of 0% reduction indicates that the compound had no effect or increased mRNA concentrations in the cell. As shown below, modified oligonucleotides complementary to human SNCA reduced the amount of human SNCA mRNA.

TABLE 76

Dose-dependent percent reduction of human SNCA mRNA in human neurons by free uptake

| Compound Number | SNCA inhibition (% reduction) | | | | | $IC_{50}$ (μM) |
|---|---|---|---|---|---|---|
| | 0.247 μM | 0.741 μM | 2.220 μM | 6.660 μM | 20.000 μM | |
| 709534 | 0 | 0 | 0 | 3 | 11 | >20 |
| 709535 | 0 | 0 | 20 | 35 | 51 | 16.97 |
| 709536 | 0 | 12 | 21 | 55 | 68 | 7.01 |
| 709883 | 19 | 0 | 22 | 15 | 22 | >20 |
| 709967 | 0 | 0 | 0 | 0 | 42 | >20 |
| 741082 | 25 | 25 | 63 | 87 | 95 | 1.37 |

Example 17: Tolerability of Modified Oligonucleotides Complementary to Human SNCA in Mice, 700 µg Dose Modified oligonucleotides described above were tested in mice to assess the tolerability of the oligonucleotides. Compound No. 387985, previously disclosed in WO 2012/068405 was also tested and is comparator oligonucleotide. Wild type C57/B16 mice each received a single ICV dose of 700 µg of oligonucleotide listed in the table below. Each treatment group consisted of 4 mice. A group of four mice received PBS as a negative control. At 3 hours post-injection, mice were evaluated according to 7 different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the table below.

TABLE 77

Tolerability scores in mice at 700 µg dose

| Compound No. | FOB 3 hour |
|---|---|
| PBS | 0.0 |
| 762836 | 0.0 |
| 762838 | 0.5 |
| 762839 | 0.8 |
| 762840 | 0.0 |
| 762880 | 5.8 |
| 762899 | 1.8 |
| 762900 | 1.8 |
| 762901 | 0.0 |
| 762932 | 4.5 |
| 762952 | 0.0 |
| 762953 | 2.0 |
| 763004 | 0.0 |
| 763052 | 6.5 |
| 763102 | 3.5 |
| 763391 | 0.0 |
| 763392 | 3.0 |
| 763393 | 4.0 |
| 763394 | 0.8 |
| 763811 | 7.0 |
| 763812 | 5.5 |
| 763813 | 3.8 |
| 763814 | 3.5 |
| 763815 | 6.8 |
| 763817 | 2.0 |
| 763818 | 3.8 |

TABLE 78

Tolerability scores in mice at 700 µg dose

| Compound No. | FOB 3 hour |
|---|---|
| 709897 | 0.0 |
| 709940 | 1.8 |
| 740416 | 1.3 |
| 741073 | 2.5 |
| 741168 | 5.8 |
| 741205 | 0.0 |
| 741229 | 1.0 |
| 741301 | 2.5 |
| 741330 | 3.3 |
| 762898 | 4.5 |
| 762949 | 3.8 |
| 762951 | 1.8 |
| 762955 | 2.3 |
| 763035 | 0.8 |
| 763040 | 2.8 |
| 763050 | 1.5 |
| 763079 | 6.5 |
| 763084 | 2.0 |
| 763085 | 0.8 |
| 763087 | 2.8 |
| 763088 | 4.5 |
| 763150 | 7.0 |
| 763151 | 6.8 |
| 763188 | 6.3 |
| 763196 | 2.0 |
| 763216 | 3.0 |
| 763225 | 6.8 |
| 763281 | 7.0 |
| 763299 | 5.0 |
| 763312 | 2.3 |
| 763359 | 7.0 |
| 763384 | 2.3 |
| 763481 | 5.3 |
| 763485 | 0.0 |
| 763650 | 6.8 |
| 762954 | 6.3 |

TABLE 79

Tolerability scores in mice at 700 µg dose

| Compound No. | FOB 3 hour |
|---|---|
| PBS | 0.0 |
| 709548 | 0.0 |
| 709632 | 6.3 |
| 740439 | 3.5 |
| 741018 | 6.8 |
| 741038 | 0.0 |
| 762895 | 3.0 |
| 762896 | 5.0 |
| 762897 | 6.0 |
| 762926 | 3.8 |
| 762946 | 2.0 |
| 762947 | 2.8 |
| 762948 | 1.3 |
| 762950 | 1.3 |
| 762956 | 6.0 |
| 763033 | 0.0 |

TABLE 80

Tolerability scores in mice at 700 µg dose

| Compound No. | FOB 3 hour |
|---|---|
| PBS | 0.0 |
| 788813 | 2.8 |
| 788814 | 0.8 |
| 788815 | 0.0 |
| 788816 | 0.0 |
| 788817 | 0.0 |
| 788818 | 0.0 |
| 788819 | 4.8 |
| 788820 | 2.3 |
| 789229 | 0.5 |
| 789230 | 0.0 |
| 789232 | 0.0 |
| 789233 | 0.0 |

TABLE 80-continued

Tolerability scores in mice at 700 µg dose

| Compound No. | FOB 3 hour |
|---|---|
| 789234 | 4.3 |
| 789235 | 4.3 |
| 789236 | 0.0 |
| 789237 | 0.0 |
| 789238 | 0.0 |
| 789239 | 0.0 |
| 789240 | 6.0 |
| 789241 | 5.0 |
| 789242 | 0.3 |
| 789243 | 0.3 |
| 789244 | 0.0 |
| 789245 | 0.0 |

TABLE 81

Tolerability scores in mice at 700 µg dose

| Compound No. | FOB 3 hr |
|---|---|
| PBS | 0.0 |
| 762837 | 0.0 |
| 762901 | 0.0 |
| 762952 | 0.3 |
| 763002 | 0.3 |
| 763032 | 5.0 |
| 763085 | 1.3 |
| 763364 | 1.3 |
| 763391 | 2.3 |
| 788833 | 0.0 |
| 789239 | 0.0 |
| 789242 | 0.0 |
| 789243 | 0.0 |

TABLE 82

Tolerability scores in mice at 700 µg dose

| Compound No. | FOB 3 hr |
|---|---|
| PBS | 0.0 |
| 387985 | 6.0 |
| 827592 | 0.0 |
| 827599 | 0.0 |
| 827606 | 0.0 |
| 827607 | 1.0 |
| 827611 | 0.5 |
| 827617 | 5.5 |
| 827630 | 0.0 |
| 827649 | 3.8 |
| 827653 | 3.3 |
| 827691 | 1.5 |
| 827695 | 0.0 |
| 827701 | 1.0 |
| 827714 | 0.0 |

Example 18: Tolerability of Modified Oligonucleotides Complementary to Human SNCA in Rats, 3 mg Dose Modified oligonucleotides described above were tested in rats to assess the tolerability of the oligonucleotides. Compound No. 387985, previously disclosed in WO 2012/068405 was also tested and is comparator oligonucleotide. Sprague Dawley rats each received a single intrathecal (IT) dose of 3 mg of oligonucleotide listed in the table below. Each treatment group consisted of 4 rats. A group of four rats received PBS as a negative control. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed. After each of the 7 body parts were evaluated, the sub-scores were summed for each rat and then averaged for each group. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. Results are presented as the average score for each treatment group.

TABLE 83

Tolerability scores in rats at 3 mg dose

| Compound No. | FOB 3 hr |
|---|---|
| PBS | 0.0 |
| 762948 | 2.3 |
| 762949 | 2.0 |
| 762951 | 0.8 |
| 763001 | 1.3 |
| 763002 | 2.5 |
| 763003 | 2.5 |
| 763040 | 1.0 |
| 763050 | 3.0 |
| 763084 | 4.0 |
| 763085 | 2.0 |
| 763087 | 2.8 |
| 763196 | 3.0 |
| 763233 | 3.3 |
| 763391 | 0.0 |

TABLE 87

Tolerability scores in rats at 3 mg dose

| Compound No. | FOB 3 hr |
|---|---|
| PBS | 0.3 |
| 762946 | 1.5 |
| 762969 | 0.3 |
| 763394 | 3.5 |
| 763813 | 1.8 |
| 763817 | 4.5 |
| 763818 | 3.0 |
| 789235 | 3.3 |
| 789236 | 0.8 |
| 789237* | 2.0 |
| 789239 | 0.0 |
| 789242 | 1.0 |
| 789243 | 1.8 |
| 789244 | 0.8 |
| 789245 | 0.5 |

*789237 group had 5 rats

TABLE 85

Tolerability scores in rats at 3 mg dose

| Compound No. | FOB 3 hr |
|---|---|
| PBS | 0.0 |
| 762932 | 5.0 |
| 762962 | 6.0 |
| 763485 | 3.0 |
| 789231 | 2.5 |
| 806693 | 4.5 |
| 806694 | 3.0 |
| 806695 | 5.0 |
| 806697 | 1.3 |

TABLE 85-continued

Tolerability scores in rats at 3 mg dose

| Compound No. | FOB 3 hr |
|---|---|
| 806698 | 4.3 |
| 806700 | 5.3 |
| 806701 | 4.0 |
| 806714 | 3.5 |
| 806715 | 2.3 |
| 806716 | 3.5 |

TABLE 86

Tolerability scores in rats at 3 mg dose

| Compound No. | FOB 3 hr |
|---|---|
| PBS | 0.0 |
| 806708 | 2.8 |
| 806709 | 2.0 |
| 806710 | 3.3 |
| 806711 | 3.8 |
| 806712 | 3.5 |
| 806713 | 2.8 |

TABLE 87

Tolerability scores in rats at 3 mg dose

| Compound No. | FOB 3 hr |
|---|---|
| PBS | 0.0 |
| 762836 | 2.3 |
| 762837 | 1.0 |
| 762838 | 0.5 |
| 762839 | 0.0 |
| 762840 | 0.0 |
| 762895 | 3.5 |
| 762896 | 2.5 |
| 762899 | 2.8 |
| 763032 | 4.8 |
| 763364 | 3.3 |
| 788833 | 1.0 |
| 788890 | 3.0 |
| 763207 | 2.8 |
| 806716* | 3.0 |

*806716 group only contained 2 mice

TABLE 88

Tolerability scores in rats at 3 mg dose

| Compound No. | FOB 3 hr |
|---|---|
| PBS | 0.0 |
| 762837 | 1.0 |
| 762901 | 2.8 |
| 762952 | 4.0 |
| 763002 | 3.3 |
| 763032 | 4.5 |
| 763085 | 4.0 |
| 763364 | 4.0 |
| 763391 | 1.3 |
| 788833 | 0.8 |
| 789239 | 0.5 |
| 789242 | 3.0 |
| 789243 | 1.5 |

TABLE 89

Tolerability scores in rats at 3 mg dose

| Compound No. | FOB 3 hr |
|---|---|
| PBS | 0.25 |
| 387985 | 3.8 |
| 827592 | 3.5 |
| 827599 | 2.0 |
| 827606 | 4.0 |
| 827607 | 1.0 |
| 827611 | 2.5 |
| 827617 | 3.0 |
| 827630 | 1.0 |
| 827649 | 5.5 |
| 827653 | 2.4 |
| 827691 | 3.3 |
| 827695 | 1.8 |
| 827701 | 2.5 |
| 827714 | 0.3 |

Example 19: Potency of Modified Oligonucleotides Complementary to Human SNCA in Transgenic Mice Modified oligonucleotides described above were tested in the SNCA PAC transgenic mouse model which uses bacterial P1 artificial chromosome (PAC) containing the entire wild-type human SNCA gene.

Treatment

The SNCA PAC mice were divided into groups of 4-8 mice each. Two groups were tested with each compound. Groups were given a single ICV bolus of oligonucleotide at a dose of 10, 30, 100, 300, or 700 µg and sacrificed two weeks later. The PBS-injected group served as the control group to which oligonucleotide-treated groups were compared.

RNA Analysis

After two weeks, mice were sacrificed and RNA was extracted from cortical brain tissue for real-time PCR analysis of measurement of mRNA expression of SNCA using primer probe set hSNCA LTS00672 (forward sequence TGGCAGAAGCAGCAGGAAA, designated herein as SEQ ID NO: 14; reverse sequence TCCTTGGTTTTGGAGCC-TACA, designated herein as SEQ ID NO: 15; probe sequence 5'-FAM-CAAAAGAGGGTGTTCTC-3'MGB, designated herein as SEQ ID NO: 16.). Results are presented as percent change of mRNA, relative to PBS control, normalized with cyclophilin A.

As shown in the table below, treatment with modified oligonucleotides resulted in significant reduction of SNCA mRNA in comparison to the PBS control. Results are a combination of two individual studies Animals were removed from analysis using ROUT at 1% to remove outliers. 763085 had 3 animals removed with ROUT analysis and 1 animal did not survive surgery. 763364 had 2 animals removed with ROUT analysis. 763391 had one animal removed with a value of 253% of control and 3 animals did not survive surgery. 789243 had 1 animal removed with ROUT analysis. 827599 had 4 animals removed with ROUT analysis.

TABLE 90

Dose-dependent percent reduction of
human SNCA mRNA in transgenic mice

| Compound No. | Dose (µg) | Cortex % Reduction | ED50 (µg) |
|---|---|---|---|
| PBS | — | — | |
| 763085 | 10 | 0 | 35 |
| | 30 | 47 | |
| | 100 | 72 | |
| | 300 | 96 | |
| | 700 | 94 | |
| 763364 | 10 | 35 | 21 |
| | 30 | 55 | |
| | 100 | 87 | |
| | 300 | 90 | |
| | 700 | 97 | |
| 763391 | 10 | 17 | 19 |
| | 30 | 67 | |
| | 100 | 68 | |
| | 300 | 93 | |
| | 700 | 94 | |
| 789243 | 10 | 35 | 61 |
| | 30 | 20 | |
| | 100 | 60 | |
| | 300 | 85 | |
| | 700 | 92 | |
| 827599 | 10 | 1 | 56 |
| | 30 | 25 | |
| | 100 | 81 | |
| | 300 | 87 | |
| | 700 | 95 | |

Example 20: Potency of Modified Oligonucleotides Complementary to Human SNCA in Transgenic Mice Modified oligonucleotides described above were tested in the SNCA PAC transgenic mouse model which uses bacterial P1 artificial chromosome (PAC) containing the entire wild-type human SNCA gene.

Treatment

The SNCA PAC mice were divided into groups of 10 mice each. Two groups were tested with each compound. Groups were given a single ICV bolus of oligonucleotide at a dose of 10, 30, 100, 300, or 700 µg and sacrificed two weeks later. The PBS-injected group served as the control group to which oligonucleotide-treated groups were compared.

RNA Analysis

After two weeks, mice were sacrificed and RNA was extracted from cortical brain tissue for real-time PCR analysis of measurement of mRNA expression of SNCA using primer probe set hSNCA LTS00672 (forward sequence TGGCAGAAGCAGCAGGAAA, designated herein as SEQ ID NO: 14; reverse sequence TCCTTGGTTTTGGAGCC-TACA, designated herein as SEQ ID NO: 15; probe sequence 5'-FAM-CAAAAGAGGGTGTTCTC-3'MGB, designated herein as SEQ ID NO: 16.). Results are presented as percent change of mRNA, relative to PBS control, normalized with cyclophilin A.

As shown in the table below, treatment with modified oligonucleotides resulted in significant reduction of SNCA mRNA in comparison to the PBS control Animals were removed from analysis using ROUT at 1% to remove outliers. The values in the table below are the average of 10 animals for all groups except the 700 µg dose, which is the average of 7 animals

TABLE 91

Dose-dependent percent reduction of
human SNCA mRNA in transgenic mice

| Compound No. | PBS | Dose modified oligonucleotide | | | | | ED50 (µg) |
| | | 10 µg | 30 µg | 100 µg | 300 µg | 700 µg | |
|---|---|---|---|---|---|---|---|
| 763391 | 0 | 36 | 51 | 92 | 94 | 97 | 21 |

Example 21: Potency of Modified Oligonucleotides Targeting Human SNCA in Non-Human Primates, 2 Week Study Modified oligonucleotides described above were further evaluated for potency in non-human primates (NHP).

Treatment

Female cynomolgus monkeys were divided into groups of 4 NHP each. Groups received a single IT bolus of 35 mg of modified oligonucleotide 789243, 763391, 763364, 763085, or 827599. One group of NHP received a dose of artificial cerebrospinal fluid (aCSF). The aCSF-injected group served as the control group to which oligonucleotide-treated groups were compared. After two weeks, NHP were sacrificed and tissues were collected for analysis.

RNA Analysis

RNA was extracted from various neural tissues for real-time PCR analysis of mRNA expression of SNCA as in the previous example. Results are presented as percent change of mRNA, relative to aCSF control, normalized with NHP Cyclophylin A. As shown in the table below, treatment with modified oligonucleotides resulted in reduction of SNCA mRNA in comparison to the PBS control with some of the treatment groups. The lumbar cord is an average of 3 NHP for 763391 because one lumbar sample was only able to obtain cauda aquina, and thus not from the lumbar region.

TABLE 92

Reduction of human SNCA mRNA in Non-Human Primates

| | % Reduction | | | |
| Compound No | Lumbar Spinal Cord | Frontal Cortex | Thoracic cord | Temporal cortex |
|---|---|---|---|---|
| aCSF | 0 | 0 | 0 | 0 |
| 763085* | 22 | 9 | 9 | 5 |
| 763364* | 0 | 10 | 0 | 10 |
| 763391 | 85 | 50 | 59 | 45 |
| 789243 | 38 | 34 | 26 | 3 |
| 827599 | 51 | 29 | 32 | 28 |

*These two oligos each contain single mismatch to cynomolgus SNCA

Example 22: Potency of Modified Oligonucleotides Targeting Human SNCA in Non-Human Primates, 13 Week Study Modified oligonucleotides described above were further evaluated for potency and tolerability in non-human primates (NHP).

Treatment

Female cynomolgus monkeys were divided into groups of 4 NHP each. Groups received an IT bolus dose of 35 mg of Compund 763391 or Compund 827599 on day one, on day 14, and then monthly for a total of 5 doses. One group of NHP received doses of aCSF rather than oligonucleotide.

The aCSF-injected group served as the control group to which oligonucleotide-treated groups were compared. A week after the final dose, NHP were sacrificed and tissues were collected for analysis.

RNA Analysis

RNA was extracted from various neural tissues for real-time PCR analysis of mRNA expression of SNCA as in examples above. Results are presented as percent change of mRNA, relative to aCSF control, normalized with monkey Cyclophylin A.

As shown in the table below, treatment with modified oligonucleotides resulted in reduction of SNCA mRNA in comparison to the PBS control.

sequence of (from 5' to 3') TTTAATTACTTCCACCA (incorporated herein as SEQ ID NO:23), having a sugar motif of (from 5' to 3'): eeekddddddddkeeee; wherein 'd' represents a 2'-deoxyribose sugar; 'e' represents a 2'-MOE modified sugar; and 'k' represents a cEt modified sugar; and an internucleoside linkage motif of (from 5' to 3') sooossssssss-sooss; wherein 'o' represents a phosphodiester internucleoside linkage and 's' represents a phosphorothioate internucleoside linkage.

Experimental Protocol

Three groups of twelve mice wild-type B6C3F1 mice were treated according to the table below. 700 µg modified oligonucleotide or PBS was administered via ICV (intrac-

TABLE 93

Reduction of human SNCA mRNA in Non-Human Primates

| | % Reduction | | | | | | | | |
|---|---|---|---|---|---|---|---|---|---|
| Comp No | Cervical Spinal Cord | Thoracic Spinal Cord | Lumbar Spinal Cord | Motor Cortex | Frontal Cortex | Caudate | Amygdala | Pons | Midbrain (level of Substantia nigra) | Putamen |
| aCSF | 0 | 0 | 0 | 0 | 0 | 0 | 0 | 0 | 0 | 0 |
| 763391 | 96 | 96 | 97 | 98 | 98 | 57 | 98 | 77 | 83 | 9 |
| 827599 | 68 | 80 | 95 | 61 | 72 | 27 | 70 | 41 | 31 | 0 |

TABLE 94

Reduction of human SNCA mRNA in Cynomolgus Monkeys

| | % Reduction | | | | | | | | |
|---|---|---|---|---|---|---|---|---|---|
| Comp. No | Cerebellar Peduncle | Corpus Collosum | DCN | Ent Cortex | Hippo campus | Hypo | Insular Cortex | Medulla (rostral and dorsal) | Caudal Medulla | Central Gray |
| aCSF | 0 | 0 | 0 | 0 | 0 | 0 | 0 | 0 | 0 | 0 |
| 763391 | 90 | 91 | 47 | 97 | 90 | 78 | 97 | 74 | 90 | 68 |
| 827599 | 61 | 67 | 37 | 71 | 25 | 25 | 68 | 38 | 54 | 9 |

TABLE 95

Reduction of human SNCA mRNA in Cynomolgus Monkeys

| | % Reduction | | | | | | | | |
|---|---|---|---|---|---|---|---|---|---|
| Comp No | VPM/ VPL | Pulvinar | Occipital cortex | Cerebral cortex | Temporal Cortex | Dorsal Medial Thalamus | Globus Pallidus | VA/ VL | Rostral Ventral Medulla | Superior Colliculi |
| aCSF | 0 | 0 | 0 | 0 | 0 | 0 | 0 | 0 | 0 | 0 |
| 763391 | 63 | 96 | 96 | 58 | 97 | 12 | 56 | 45 | 84 | 68 |
| 827599 | 26 | 59 | 58 | 0 | 72 | 0 | 0 | 13 | 52 | 9 |

Example 23: Treatment of SNCA Pathology in Pre-Formed Fibril (PFF) Model in Wild-Type Mouse, Prophylactic Treatment Experimental Model The PFF (pre-formed fibril) model in mouse is an experimental model that has been used to investigate treatments for Parkinson's disease, as described in Luk, et. al., Science. 2012 Nov. 16; 338(6109):949-53. A single intrastriatal injection of pre-formed SNCA fibrils generates Lewy body pathology characteristic of Parkinson's disease.

Modified Oligonucleotide

Compound No: 678363 is a 4-8-5 MOE and cEt gapmer that is 100% complementary to mouse SNCA, having a erebroventricial) injection on day 0, and pre-formed fibrils were administered into the striatum on day 14. On day 56, a wirehang test was performed to measure motor function, and mice were sacrificed for mRNA and histological analysis. P-α-Syn aggregates in the substantia nigra were stained and quantified. Mouse SNCA mRNA was measured with RT-PCR as described above, using mouse primer probe set RTS2956 (forward sequence GTCATTGCACC-CAATCTCCTAAG, designated herein as SEQ ID NO: 17; reverse sequence GACTGGGCACATTGGAACTGA, designated herein as SEQ ID NO: 18; probe sequence CGGCTGCTCTTCCATGGCGTACAA, designated herein as SEQ ID: 19). SNCA mRNA levels were normalized to cyclophilin A and are presented as % of mRNA level in PBS-treated mice. As shown in the table below, modified oligonucleotide treated mice had reduced SNCA mRNA, fewer aggregates in substantia nigra and improved performance on the wirehang test as compared to PBS treated mice.

TABLE 96

Pre-formed fibril (PFF) model in wild-type mouse, prophylactic treatment

| Treatment group | Treatment Day 0 | Day 14 | SNCA mRNA Mid-brain | stri-atum | Avg. # aggregates in substantia nigra | Wirehang (seconds) |
|---|---|---|---|---|---|---|
| Naïve (Naïve) | PBS | none | 90 | 98 | 0 | 192 ± 82 |
| PBS + PFF (PBS) | PBS | PFF | 100 | 100 | 42 | 94 ± 69 |
| 678363 + PFF (Treatment) | 678363 | PFF | 51 | 47 | 0.64 | 154 ± 64 |

Example 24: Treatment of SNCA Pathology in Pre-Formed Fibril (PFF) Model in Mouse, Post-Symptomatic Treatment Experimental Protocol Three groups of twelve wild-type B6C3F1 mice were treated according to the table below. Pre-formed fibrils were administered into the striatum on day 0 and 700 µg modified oligonucleotide or PBS was administered via ICV (intracerebroventricial) injection on day 14. On day 56, a wirehang test was performed to measure motor function, and mice were sacrificed for mRNA and histological analysis. Phosphorylated-α-Syn aggregates in the substantia nigra were stained and quantified. Mouse SNCA mRNA was measured as in the previous example and normalized to PBS treated mice. As shown in the table below, modified oligonucleotide treated mice had reduced SNCA mRNA and fewer aggregates in substantia nigra and improved performance on the wirehang test as compared to PBS treated mice.

TABLE 97

Pre-formed fibril (PFF) model in wild-type mouse, post-symptomatic treatment

| Treatment group | Treatment Day 0 | Day 14 | SNCA mRNA Mid-brain | stri-atum | Avg. # p-αSyn aggregates in SN | Wirehang (s) |
|---|---|---|---|---|---|---|
| Naïve (Naïve) | PBS | none | 102 | 85 | 0 | 226 ± 88 |
| PFF + PBS (PBS) | PFF | PBS | 100 | 100 | 49.4 | 58 ± 63 |
| PFF + 678363 (Treatment) | PFF | 678363 | 32 | 32 | 1.9 | 132 ± 77 |

Example 25: Treatment of SNCA Pathology in Pre-Formed Fibril (PFF) Model in Mouse, Long-Term Prophylactic Treatment Experimental Protocol Three groups of twelve mice wild-type B6C3F1 mice were treated according to the table below. 700 µg modified oligonucleotide (control or treatment) or PBS was administered via ICV (intracerebroventricial) injection on day 0, pre-formed fibrils were administered into the striatum on day 14, and an additional 700 µg modified oligonucleotide or PBS was administered via ICV on day 90.

Control groups included a PBS-treated group and Compound No. 676630-treated group. Compound No: 676630 is a 5-10-5 MOE gapmer that is not complementary to mouse SNCA, having a sequence of (from 5' to 3') CCTATAGGACTATCCAGGAA (incorporated herein as SEQ ID NO: 2795) and having an internucleoside linkage motif of (from 5' to 3') sooossssssssssssoos, wherein 'o' represents a phosphodiester internucleoside linkage and 's' represents a phosphorothioate internucleoside linkage.

On day 180, mice were sacrificed for mRNA and histological analysis. Phosphorylated-α-Syn aggregates and neurtic pathology in the substantia nigra were stained and quantified for 6 mice in each group. Additionally, the number of TH (tyrosine hydroxylase)+cells in the substantia nigra pars compacta (SNpc), which is measure of death of dopaminergic neurons, were quantified for 6 mice in each group. Results are presented relative to the PBS-treated group. As shown in the table below, Compound No. 677363-treated mice had reduced SNCA mRNA, fewer aggregates in substantia nigra, and reduced neuritic pathology in substantia nigra as compared to PBS and 676630-treated mice.

TABLE 98

Pre-formed fibril (PFF) model in wild-type mouse, long-term prophylactic treatment

| Treatment group | Treatment Day 0 | Day 14 | Day 90 | SNCA mRNA Midbrain | striatum | Avg. # p-αSyn aggregates in SN | Avg. # neuritic pathology in SN | TH cells (% PBS) in SNpc |
|---|---|---|---|---|---|---|---|---|
| PFF + PBS | PBS | PFF | PBS | 100 | 100 | 271 | 1002 | 100 |
| 676630 (Control) | 676630 | PFF | 676630 | 95 | 107 | 160* | 580* | 99 |

TABLE 98-continued

Pre-formed fibril (PFF) model in wild-type mouse, long-term prophylactic treatment

| Treatment group | Treatment Day 0 | Treatment Day 14 | Treatment Day 90 | SNCA mRNA Midbrain | SNCA mRNA striatum | Avg. # p-αSyn aggregates in SN | Avg. # neuritic pathology in SN | TH cells (% PBS) in SNpc |
|---|---|---|---|---|---|---|---|---|
| 678363 (Treatment) | 678363 | PFF | 678363 | 59 | 70 | 0.7 | 51 | 139 |

*number represents the average from 4 mice.

Example 26: Tolerability of Modified Oligonucleotides Complementary to Human SNCA in Mice, 700 µg Dose Modified oligonucleotides described above were tested against Compound Nos. 1233344 and 1233345 (described herein below) to assess the tolerability of the oligonucleotides.

Compound No. 1233344 is a 15-mer gapmer, that is complementary to SNCA (wherein the 5'-most nucleoside to which the gapmer targets SEQ ID NO: 1 is at position 370), having a sequence of (from 5' to 3') CTACAT-AGAGAACAC (incorporated herein as SEQ m No. 2796), wherein each of the nucleosides 1-3, nucleoside 13 and nucleoside 14 (from 5' to 3') comprise an LNA sugar modification, and each of the nucleosides 442 and nucleoside 15 are deoxynucleosides, wherein the internucleoside linkages between the nucleosides are phosphorothioate internucleoside linkages, Compound. No. 1233344 is characterized by the following chemical notation: $C_{lnas}T_{lnas}A_{lnas}C_{ds}A_{ds}T_{ds}A_{ds}G_{ds}A_{ds}G_{ds}A_{ds}A_{ds}C_{lnas}C_{d}$ wherein, A=an adenine nucleobase.
C=a cytosine nucleobase.
G=a guanine nucleobase,
T=a thymine nucleobase,
d=a 2'-deoxyribose sugar,
s=a phosphorothioate internucleoside linkage, and
lna=an LNA modified sugar.

Compound No. 1233345 is a 15-mer gapmer, that is complementary to SNCA (wherein the 5'-most nucleoside to which the gapmer targets SEQ ID NO: 1 is at position 372), having a sequence of (from 5' to 3') GCCTACAT-AGAGAAC (incorporated herein as SEQ m No.: 2797), wherein each of the nucleosides 1-3, nucleoside 13 and nucleoside 14 (from 5' to 3') comprise an LNA sugar modification, and each of the nucleosides 442 and nucleoside 15 are deoxynucleosides, wherein the internucleoside linkages between the nucleosides are phosphorothioate internucleoside linkages. Compound. No, 1233345 is characterized by the following chemical notation: $G_{lnas}C_{lnas}C_{lnas}T_{ds}A_{ds}C_{ds}A_{ds}T_{ds}A_{ds}G_{ds}A_{ds}G_{ds}A_{lnas}A_{lnas}C_{d}$ wherein, A=an adenine nucleobase.
C=a cytosine nucleobase,
G=a guanine nucleobase,
T=a thymine nucleobase,
d a 2'-deoxyribose sugar,
s=a phosphorothioate internucleoside linkage, and
lna=an LNA modified sugar.

Treatment

Wildtype C57BL/6 mice each received a single ICV dose of 700 µg of modified oligonucleotide listed in the table below. Each treatment group consisted of 4 mice. A group of four mice received PBS as a negative control. At 3 hours post-injection, mice were evaluated according to 7 different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching, (7) regular breathing. For each of the 7 criteria, a mouse was given a subscore of 0 if it met the criteria and 1 if it did not (the functional observational battery score or FOB). After all the 7 criteria were evaluated, the scores were summed for each mouse and averaged within each treatment group. The results are presented in the table below.

TABLE 99

Tolerability scores in mice at 700 µg dose

| Compound No. | FOB 3 hour |
|---|---|
| PBS | 0.0 |
| 763085 | 2.3 |
| 763364 | 2.8 |
| 763391 | 0.0 |
| 789243 | 1.0 |
| 827599 | 1.0 |
| 1233345 | 6.8 |
| 1233344 | 2.3 |

SEQUENCE LISTING (2797 sequences)

SEQ ID NO: 1 - DNA, 3215 bp, Homo sapiens
aggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaata

SEQ ID NO: 2 - DNA, 119001 bp, Homo sapiens
aaagaaaaattaaaaaaactttattttaacttctagttcccttctttgtacttgagcagctttccctccttaagaatacagacctagaacatatgcaatatcactatcaatattatgtgtaattaaaagttcattggatgtttactgtgttcaaggcattttaaggagtgacaagagttaaacatatagttgtaattcaaaatgacaacgaaattagtttacagttttctttttttgtaggtagtaagaaatcatctccccctattgaggaataccaatatagaaaaggcaaaactttaaatatgaatgaactgtttcataataacataagttcttcttgatttccattgtcacatccaaatttgaaggctatttctaacacagctgggttctacctttttccttctcactctttaccacacccaatctgtgaggcttcagacacaaactgctaattcaggagacaattgtgccttctgtaacagtttctgctaaattgtctcagctctgccacttaaaatagctaggtgatctcagcatatcaccaaaactcttggagctcagtttctctgtctataaaagttacataaaatgtaattgatctgcttgttatgactaaataacatagtacattagtcctttgccaaaggactaacaaattaccaaataaaagtttggaatcatgttaaacgtttataagaagtgcaactgtccagaaataattctctcacattggtctgttgtaatgagacctaaaatatctcattttatttacctctttgacttaaagcactaggtctcaaggaggtcatggttatactataaatatgtcatgtgaaataatatattaaataattgttgtaatactctattgagatactagttgtaaagaggcacaatggaaaacttatactattaacagtagtaaaaagaaacaacaaaaagcaataaaaaacaaaacacccattcatgcaacgacatgaacgaacctcacaaatattatactgagtaaaagaagtcagacaaatataaaacaaagtttatactacgtgattagatctttatgacattctagaatatgcacatgaaggtacaaggtaactgtctggaatgatgaaaatgtcctgtgtcttcaaaatagtgtgggttacactaatgcatggctttttcaaaactgatttaaagggacacaacatctgagcatttccctaggtgtaaattacactgcaattttaaagaatcatctaatgatattgtggttatttttaaacagtccttaaattttgtggatgcatactgaatgtttacagctgaaaagatatatataaagcttgaatttggtaaaaaaaaaaaaaaaagagggaggattggtagtgataaagtgagtggacttatggatgagacatgatcagccatgcattgaaaaaatgtaaaagttggatgatcttcacatgagagtcctttattctgtctacttttgcatatgtttgaatatttcccataacaaaaagttgaaaatagagtgatcacatgagttaatctcctaatttacaaaaaagaaaactggaaacagaaggagaacaaaacttgttcaaggtctcaaagccagacagcaaactagctcccaagtccaaccttcttgctctggtcctaagcaaacaaaaaatattaatatgagctactgcattaaggaaagtctgcttttccaaagggcagaccaatagttcaaggaagagtttaaataataaatatttgtgatcttactttcatgcttttctattttccactgaacacatatgcattatcttctatatgtcttttatgtataatcatttgcttcctgttccttgtggttttaaagttgttttgtatgtttaaatttgattttactcaaatttcagaacccaaattagcgcaagaatcagacaaagcataactttctataaatataaaaacaattaaaaaaaaaacatacagcaaaaacgagttgttgtttcccccctcctcttccagtgcttaactaatcttccgaatccaggcacagaaagcaaaggctttctgctagtgggaggagcttgcttctccattctggtgtgatccaggaacagctgtcttccagctctgaaagaggtgaaaatgtgttaagcgatgcaaaaattgtcttgaagttcgcgtgtgtatgtctgtgtgcatgtgcgtgtggtgggtggggggagagaaaagggggtgtcaattctgagggcaacgagaatcagaagtcagaaaggtgagtggtgtgtagcatctccctttcagaaggggctgaagaagaaattggatatgatggtccggtaggctaaatcacgctggatttgtctcccagataaagggaggtctgcaaagtaagtcccatttctagagcgaaaagccttaggaccgcttgttttagacggctggggaatatttattccttgttccactgatgggaaaatcagcgtctggcaggcgctgattggtggaaaggaaaatggtgatagtggcgtggaaagaggatttgctgagccttctcctgcctcctcaacctgtgactcttccttagtagtctccctttcaccctcaggaccctttccggctcttcctagattaagagcaaacgaaaaccttgaagatatttgaactaaagcgacccctaacgttgtaacctgtgaccgtgattaaatttcagcgatgcgagggcaaagcgctctcggcggtgcggtgtgagccacctcccggcgctgcctgtctcctccagcagctccccaagggataggctctgcccttggtggtcgaccctcaggccctcggctctcccagggcgactctgacgaggggtagggggtggtccccgggaggacccagaggaaaggcggggacaagaagggaggggaaggggaaagaggaagaggcatcatccctagcccaaccgctcccgatctccacaagagtgctcgtgaccctaaacttaacgtgaggcgcaaaagcgcccccactttcccgccttgcgcggccaggcaggcggctggagttgatggctcaccccgcgccccctgccccatccccatccgagatagggacgaggagcacgctgcagggaaagcagcgagcgccgggagaggggcgggcagaagcgctgacaaatcagcggtgggggcggagagccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcaggtaagtacctgtggatctaaacgggcgtctttggaaatcctggagaacgccggatgggagacgaatggtcgtgggcaccgggagggggtggtgctgccatgaggacccgctgggccaggtctctgggaggtgagtacttgtccctttggggagcctaaggaaagagacttgacctggctttcgtcctgcttctgatattcccttctccacaagggctgagagattaggctgcttctccgggatccgcttttccccgggaaacgcgaggatgctccatggagcgtgagcatccaacttttctctcacataaaatctgtctgcccgctctcttggtttttctctgtaaagtaagcaagctgcgtttggcaaataatgaaatggaagtgcaaggaggccaagtcaacaggtggtaacgggttaacaagtgctggcgcggggtccgctagggtggaggctgagaacgccccctcgggtggctggcgcggggttggagacggcccgcgagtgtgagcggcgcctgctcagggtagatagctgagggcgggggtggatgttggatggattagaaccatcacacttgggcctgctgtttgcctgagtttgaaccacaccccgagtgagcagttagttctgttgcctacgcctttccaccatcaacctgttagccttcttctgggattcatgttaaggatacccctgaccctaagcctccagcttccatgcttctaactcatactgttaccctttagaccccgggaatttaaaaaaggggttaatcttttcatgcaactccacttctgaaatgcagtaataacaactcagaggattcatcctaatccgtggttaggtggctagacttttactagccaagatggatgggagatgctaaatttttaatgccagagctaaaaatgtctgctttgtccaatggttaaatgagtgtacacttaaaagagtctcacactttggagggtttctcatgatttttcagtgttttttgtttatttttccccgaaagttctcattcaaagtgtattttatgttttccagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggtaggtaaaccccaaatgtcagtttggtgcttgttcatgagtgatgggttaggataatcaatactctaaatgctggtagttctctctcttgattcatttttgcatcattgcttgtcaaaaaggtggactgagtcagaggtatgtgtaggtaggtgaatgtgaacgtgtgtatttgagctaatagtaaaaaatgcgactgtttgcttttccagatttttaattttgccctaatatttatgactttttaaaaatgaatgtttctgtacctacataattctatttcagagaacagttttaaaaactcatagtcttttaaaaaataatcaagaatattcttaagaatcaaaatcattgatggatctgtgatttcttttaccatcatgaaaaatgtttgtcaattttaatccattctgatttttaaaatatgactttgatatgcccctgtgatgtgtataaagagacctatttgtggccctaaaatggaaagaacagattagtctttgatagagttacttcatgtgatcatttggtctctgtgaacactgaggacagagaaaagtgcttgagggctgctactaatctctcagaaacatttgtatagttcatccatcaaatgacacacatactaaaagaataaagaaattgatgcttattacctacttgttcctaaagttccaccttggggtatacacccaaactctgactctcttttctgtaacttgaactgtattcaattgagtgttattttacaaaccactttgaattccttggaaaagaatagacacacactctcatccacaggcatagacacacacactcaacacagacacattgcccattcttcctctcttctttctcctctgagctttttcacattctctggtggcaactatagcagtaagagtcacaggatgaacagtcaggtggaggatgaccacattgagttgcctagctgaaacatgtgctccgtctatgtctgcaaagtgaaagaaagctacactatctcttcaacatagatcagtgggggaaattttatacttgggatgatttatatgaatgcatctcatcaaagttcacaacacatttttttttcagttttttattttcagtttttagagtcagggccttgctctgtcgcccaggctggactgcagtgatgctatcatagctcactgcatccttgaattcctgggctcaagtcatgcccccacctcagcctcctgagtagccaggattataggcatgtgccactgcctcattatttagacttttcttatgttgacttaatcttcccacaaatcttcaattaaattactttttttctaccttaaaacatattttcagaaagtcattgaaatagggtgttacaagaggaaaaaattgatgagttaattttaaatattttatgaagtgtgaattatacctttttagatggaatttggaatactgaatcagtgacatgcagtttatcaatatctttccgtttgtcctcagatttccaagttctgcaagcacaagtttctttgacttagttaccttttaactgttcattgaaatcattttcaatgtctctcatggcatttaacacatagcacattctataaattttttattggttacattctgagttctaattgagagttgaacttacacacagaatttaagataaaaaatgaccatgtgaagacacaatagtatagtccagggattggcaaaattttgggtaaggaatcagatagcacgtattttaagccatgagatctatgtcttggccaggtgccgtggctcaggtctttaatcccagcactttgagagcccgaggctggtggatcacttgagcccaggggtttgagaccagcctgggccacatggtgaaaccctgtgtctacaaacaacgcaaaaattagccgggtatggtagcatgcatgtgtattgccagctacccaggaggctgaggtaggaggatggcttgagccatacagctcactgcagaggttgcagtgagctgagatcgagccactgcactccagcctgggtggcagagtgataccctgtctaaaaaaaagaaaaaaaaatctatgtctcaattctgctgttgaagtgtgaaggtagtcataaacaataactagtgtggctgtgtcccaataaaacttcatttatcaaaacaggtggtgggctggaattgtcttgtatgttgtagcttgctgactactgatagagtggaaagaacatgcactaatcacacaaaccaaagttttagttgagactacatcacttatcacctttagggtcttggggaagcgtacttaacatctctgagcatcacttccctgattagtaaaaaatatgatttagaaaactgcaactaccttgcagtttttgtgggaatgtcataataagacaggacatatgaataattgagcacacttttatatataggaaccatggttattattatcaaataaactctccaacggaataattactttgccaacacgttttccatttattcttttatccttcattacataactagtttgaaagattggaggcgaccaaagaccattttataatttcacttatggctgaagatgtttggtagaagcctcataagaaaagtaatctcattcctttataagaatatacttttaacaactactttttaactcattgaagaactaccttaatgatcagtgttatttttatgggttttgttccctccatttttgttatctgcgtacaccaattttcaatcaacatacttcaatttaatagacaaaaatttcttcaaatgactcagaaattaattagatctaaatccaaaagcagaaagatttaattatctttatataatgctcagtaatataaatgcaataaatacaagaaaatgatgatctttgagtgtcttccaatgccactctgctcaataagcagcagtggccatcagtgaaattgatagcaaattctcaagtcaaaatgtgcttcacctcactaagctgacaaagtcaacataacatgcacaacagggataactgagttctcaaaactctcaggtattacttctgaccttcttctccactctgtgctcttttgaggttgggaagacaagatagggtgtgtgtgggacacctccgctcagggaagccatcagctctggtgtccctacagcatttataccttgctagtcacataaccacttggcacctattttgtaggtgtacgttatcaattacagattactcataaattaaaggctaaccatcaattacagattattagtaaataattatgacctcaaagaacaactgattggtttgatacatggtaaccttatgaggactctcatttatctcgtttttttaagttatatacctatctctttggggttgcactacaaaaatataaaatatgttgcataagatatttataaaaaataattaattataagttctaatggtgtggtttagtggcattcttttttttttctttttttctgagatagggtctcaatctgtcatttcactccaggctgaagtgcagtggtgtgatctcggctcactgcaacctccgcctcctgggttcaagttattctcctgactcagcctcctgagtagctgaaattacaggcatgcaccaccatgcccggctaatttttgtatttttagtagagatggggtttcaccatgttagccaggatggtctcgaactcctgatctcatcatccccgacctcggcctcccaaaatgctgggattacaggcgtgagccattgcacccggcctagtggcattcttttttaaaaataaatttaattgtgtatatttagggtatgcaacatgatgctatcagatacattagacactaaaaaattactatattgaagcaaattaatatattcataatctctcatagttaccttttttgttgtttttgtggcaagggcagctaaaatccacttatttatcatgaatctcaaatatagtacaattttatcacctacagtcctcatacattagatctgtacactttttcatcttacacatctgctacttgcttggatcctatggcctatatgtccctattttctacctacttttccacccctattaaccctgttttttacgtagtctctgtatatttgaattttgtttcaagcttccacatatatgtgagataatgtaatatttttctttctgtgtttggcttatttcacttagcataattttgtctgggttcatccatgttgtaaatggtaggatcttgtttttttagggctgactgatattccattgtatctatgtaccacaatctttttatctacctatctatcagtagacactttagttgtggctattatgtttttctttttttcttttttggagacagggtcttgctgtcacccaggctgcaatggagtggtgttatcatagctcactgtaacctcaaacttctgggctcaagagatcctcctgccttggcctcccaagtagctgagactacaggcatacattaccatgcctggctaatttttaatattttttgtagatatagcatctcactctgttgcccagactggtctcaaactcctaattcaaatttagaatagagtatgacaattctgtaaaatataaaaaacatgtccactccgtataggaagttatacaatgagaagaagacaaacactatttacattactcttgataagttttttacaaagaaataaaacactttaatttctaatgttttaaattctggtttgctaaataaataaatattagttttagtgtttttaaaattccttatatagttataagtgatcttcctgcctcagcctcccaaagcactgggattccaagcaagagccactgtgttggggcccttggaaacagatatgctgaaatcttttcttgtggatctacacccagaagagggattgctgggtcatatgctactctatttttaatttttcttttatttttagtgaatatgtaataattgtatataattgtgggatccagaattatatttccatacatgtatacaatgtgtgataatcaaattagggtaattaacatatccattacctgaaacatttatcattcctttgtggtgggaacagtaaaaattaaaaattctctcttctagatttttgaacatatgcaataaactattgttaagtatatcaccctacagtactacagaatgctagaactcattcctcatatttggctccaatttcatattctttaaccaacctctccatatcctcccctccctcttaccgttgtcagcctctaataatcataattctactctctacttctatctcattgtctttgatttagaatatgtttcataatttaaccaaaggtcaaattcttaggtactgctaaggcaaagaacaaagatcgcattccagctgttagacatttcttactactagtcatttttaagacaacatggggtgcaggtggtgaggatgagagatagagattgaaacatattctcttaaatatcagctgttctcactctgcatagttccagcacaaacaaattccaggtactatggttagttaaataacaccagccactaacaacacaattcaaatttctgttaccacagtataccgaaagtcattgcataaagtacaaactttgctgctaactcttcagccttcaaatcattacataaataacagaaacccattataatcagtgacaaaaccacagcacttctttcaaagctttttggagattggttgcttcacatctgttatgcagttcatacagacagcaatgcccggacttgtgtggccacattgtctcccagtggtgagcccatgtgatgtttcacgaaaatgcgcaatcaaaagaggaaactggccagcaaagatgaaagagtagcaaacaaaggaagtgaaacattctggaagtaaaatttgaatcaaacataagttgatgtatacaggaagtagctaccctgaggatgttgtcactgctgcaattcaggagactctaaatatgcagtcagaggaacgtagtgaggtgaaggtatccgtataatggggaaagaggttgtgataaagagtgaaggtgtcccagaggaagtgttgctgaaaaatacaccttatgttaaatacactgtcagtatatcatgacattaaagtgcaaatgataacattttgtaaactgatccaaacttaaaaaggagtatgataattctgtaaaacataaaaatcatgccgattccataaattatacagtgtgaattacactgaaaaatccaacattagagaggatatgaatacaattttttacaagcataattttaataatacacataataattatttgtattcaagtttagtaatgttcaaggtttggaagaaattctgatcctgtgtagagaccctagtttgaatgtgcttatagcctattattacatgtgtaatgttacataaattacttaactcggatttttaatttcatcagctatttaaaatgggcataatataactatattaaatggctgttatgaagattaaataagatgatatgtaaaatgtgttttttgtttgtttgtttgtttgtctgtttgtttttttgagacagagtcttgctctgttacccaggctggagtgcagtggcacaatcttggctcactgcaagttctgcctcccgagttcatgccattctcctgcctcagcccctcccaagtagctgggactacaggcacccgccaccacgcctggctaattttttgtatttttggtagagatggggtttcaccatattagccaggatggtctcgatctcctgacctcgtgatctgcccacctcggcctcccaaattgctgggattacaggcatgagccactgcgcccagcctaaaatgttttttttacataatgggtgttcagcacatgttaaagccttctctccatccttcttcccttttgtttcatgggttgactgatctgtctctagtgctgtacttttaaagcttctacagttctgaattcaaaattatcttctcactgggccccggtgttatctcattcttttttctcctctgtaagttgacatgtgatgtgggaacaaaggggataaagtcattattttgtgctaaaatcgtaattggagaggacctcctgttagctgggctttcttctatttattgtggtggttactggagttccttcttctagttttaggatatatatatatatttttttctttccctgaagatataataatatatatacttctgaagattgagatttttaaattagttgtattgaaaactagctaatcagcaatttaaggctagcttgagacttatgtcttgaatttgtttttgtaggctccaaaaccaaggagggagtggtgcatggtgtggcaacaggtaagctccattgtgcttatatccaaagatgatatttaaagtatctagtgattagtgtggcccagtattcaagattcctatgaaattgtaaaacaatcactgagcattctaagaacatatcagtcttattgaaactgaattctttataaagtatttttaaataggtaaatattgattataaataaaaaatatacttgccaagaataatgagggctttgaattgataagctatgtttaatttatagtaagtgggcatttaaatattctgaccaaaaatgtattgacaaactgctgacaaaaataaaatgtgaatattgccataattttaaaaaaagtaaaatttctgttgattacagtaaaatattttgaccttaaattatgttgattacaatattcctttgataattcagagtgcatttcaggaaacacccttggacagtcagtaaaatgtttattgtatttatctttgtattgttatggtatagctatttgtacaaatattattgtgcaattattacatttctgattatattattcatttggcctaaatttaccgagaatttgaacaagtcaattaggtttacaatcaagaaatatcaaaaatgatgaaaaggatgataatcatcatcagatgttgaggaagatgaggatgagagtgccagaaatagagaaatcaaaggagaaccaaaatttaacaaattaaaagcccacagacttgctgtaattaagttttctgttgtaagtactccacgtttcctggcagatgtggtgaagcaaaagatataatcagaaatataatttatataatcggaaagcattaaacacaatagtgcctatacaaataaaatgttcctatcactgacttctaaaatggaaatgaggacaatgatatgggaatcttaatacagtgttgtggatatgactaaaaacacaggagtcagatcttcttggttcaacttcctgcttactccttaccagctgtgtgttttttgcaagattcttcacctctgtgtgatttagcttcctcatctataaaataattcagtgaattaatgtacacaaaacatctggaaaacaaaagcaaacaatatgtattttataagtgttacttatagttttatagtgaactttcttgtgcaacatttttacaactagtggagaaaaatatttctttaaatgaatacttttgatttaaaaatcagagtgtaaaaataaaacagactcctttgaaactagttctgttagaagttaattgtgcacctttaatgggctctgttgcaatccaacagagaagtagttaagtaagtggactatgatgccttctagggacctcctataaatatgatattgtgaagcatgattataataagaactagataacagacaggtggagactccactatctgaagacggtcaacctagatgaatggtgttccatttagtagttgaggaagaacccatgaggtttagaaagcagacaagcatgtggcaagttctggagtcagtggtaaaaattaaagaacccaactattactgtcacctgatgatctaatggagactgtggagatgggctgcatttttttagtcttttccagaatgccaaaatgtaaacacatatctgtgtgtgtgtgtgtgtgtgtgtgtgtgtgcgtgtgtgtgagagagagagagagactgaagtttgtacaattagacattttataaaatgttttctgaaggacagtggctcacaatcttaagtttctaacattgtacaatgttgggagactttgtatactttattttctctttagcgtattaaggaatctgagatgtcctacagtaaagaaatttgcattacatagttaaaatcagggttattcaaactttttgattattgaaaactttcttcattagttactagggttgaatgaaactagtgttccacagaaaactatgggaaatgttgctaggcagtaaggacatggtgatttcagcatgtgcaatatttacagcgattgcacccatggaccaccctggcagtagtgaaataaccaaaaatgctgtcataactagtatggctatgagaaacacattgggataaatcggctgctatcataatcattcctctcccacatcagataaatgaattaactttttgaatagggttatttaatataaagtgcttaagtctaattatgagaagaaataagataattacacttcaatggttaaagagagggagaataatttgcatattatgcctgatgtaaaatgtttattatgggtacatattaagtgctaactaattgttaattgttcttgctacaagtcttaatgcagggaaacaagaaattattacatagtacctaatattatcttctaatattaaagaaacaatttcccctaaattcatcccattagctttttttttttcggtggggcaggggagaaatacagacttcagtaaacttgggctgggaactttctacctacaaagttcaaataaaataaattatcctagttagataatatcaatgaaaaatccaccaacttaaatcctggctgtttgatctcaggaaattatttcagttatcaacttaatgcatcatattatagaaatatatgaaaatgtgtttaattaaacttactgaatgatatgttttttcaggtactttaaaaataaactatgatataaagttacctatttttcatgcaagtatagtataaagaaatttctaacactggagattttctgaaggttttgattcttataaatttattacatcataatgaacaaaactaattttcaacatattatgatttaaatttccttagtaaattgtttcaaatttattttctttaaatccatatttacatatgtatatttaaatatacatatttacttgtataacaattcaaaaccatatattaattttataattttgtttaatgtcaaaggttagatttggctatatctattctaaaagttggtatcacatttcctttttggaattttatttttaaagtagctaaagtcaaatataaacctattatttatattaatgcagacattagaggtagacactaaattcattttagtatattctaaattatttattatctactatgaaataatataaagaaaaataaagcagaatccctgatttcaaagaactcaattgccgaaaaacagttaccatttattagacccaaaatgtactaatatgagtgtgtctcttttccttttgttttgtcacccgtcatttggaatgtcagtgagtagagagatagtgtgaaaggccctcaaggggaaaaatagaggttaaaggtcagcagagaccctactagagaaatcagttctacagaaatgtttttaaatgtgtcgattattgctacatgtacactctgtcattttgtaatgtagccattttatttatgattataataataaaacaacaaaattataataatgtgtagagtacattttactgtgcagtgtattgcattaaaactagattaaaatttatacatatataaaaggctatctagatattataaaatttatggctggatctgtaaaaaattcaaaacctatttttaatctcgctttgagattttataacaagaaaatgttcgtttcaagcaaaattttcaattcacgtccttgaaaaggaaaaaaatgacaacttgaaacacataattgactatttttaaaggatcaacatttcagaaatgttttaaaacataagattttcagtacagcttttcgctggcatttaaatcgaactttgaattgtaaatagctcttgctcttaaggagacatcagccatatccttagaagtggcacggagttgttaggtagttgtacaaaattctagcctaaaagacaaatagggagcaacactactgtggaccgtttctggtcttgggctgtgtggctatgtcaggcttgcccacattgcctgtactaaggagaaagcctcttgtccttacagacccccttagcttacatagtctatttgaaaacaaattgctttgtccacaccatttaaatattggcttcaggccaggcgcggtggctcacgcctgttatcccagcactttgggaggctgaggcgggcagatcacgaggtcaggagatcgagaccatcctggctaacacggtgaaaccctgtctctactaaaaatataaaaaaattagccgggtgtggtggcgcgcacctgtagtcccagctgctggggaggctgaggcaggagaatggcctgaacccgggagtcggagtttgcagtgagccgacatcgtgccactgcactccagcctgggtgacagagcaagactccgtctcaaaataaataaataaataaataaataagtaaatattggcttcttcaactggtgagatgaaacctatacaatagtcatgtgaatagcactaaacagctgacatggtgtaactcctctcagactgaggcttatctggggagtacaaagcatgtcaagaaaatgtgccttcatttccttagatgagtgtccccatcctccactctcctccactgttctcctctctgcttctatgatatcaacttttctttttctttagattccacatgagtgagatcatgtggttgtttgcctttctgtttctggcttatttaactgaacaagaaagtttttgacatgaaattaaacttctgcttgtaaactcaattcaaactatttacactgtcttctcaaaaatgttaacttattttaataaatctactgaatgaccgtatctcattttgttttatgaaaagaaattgtaagggtgctcaatagcctcttcattttcatactgtctagctcctgtgctcctattaaaattactgcaaatttagctttttaagaaccctttgtttcactacctgaagttctataaaaagatccaagttccttcacaaccgtttcttatgctgttattcgtacatatgtgataataccacgtctgaacacgtagataataagtaggggctgggtgcggtggatcatgcctataatcctagcactttgggaggctaaggcgggtggatcacctgaggttaggagttcgagaccggcctggccaacatgatgaaaccctgtttctactaaaaatacaaataataataataataataattagccaggtgtggttgtgggcacctgtaatcccagctactcgggagactgaggcaggagaatagcttgaactcaggaggcggaggttgctgtgagctgagattgtgccattgcattccagcctgaacaacaagaatgaaactccatctcaaataaataaataaatagaagtatgtattgtgttgcttagaaggtgtggtggaaattaacttgctgagtgagatcaaaggattggcactgaattgaaataaagaaatattcatgctgagtctggttcaaatataactgcacctgtaagaattgctttctgtaaactttccatagtataaaccaaatccaaatcactcatggctttacattcctgatcgttaaacttgaagcactttttaatactgcatgactttagccaaaatatcttagccaagattcaatgtttggttgaaccacactcacttggacatcttggtggcttttgtttcttctgaccactcagttatctatggcatgtgtagatacaggtgtatggaagccgatggctagtggaagtggaatgattttaagtcactgttattctaccaccctttaatctgttgttgctctttatttgtaccagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggtatggctgtgtacgttttgtgttacatttataagctggtgagattacggttcattttcatgtgaggcctggaggcaggagcaagatacttactgtggggaacggctacctgaccctccccttgtgaaaaagtgctacctttatattggtcttgcttgtttcaggcattaacccagataaatgccatgcaaattttataattattatgattgtttcaatttctggaagaaagttaatgaaacaaaaaatgtagtaaaatgccaaaggaacagtgacatttcagaaagaatgagggctttcatgttaattgtaagtcttggaatttctcttccttggagtaacaaatccctttgtgcctaatttcctaatttccaaaataaagttcttttacttatttctttatagtgacatcatctcttattaaatggcatatctgcatattacataacagttcattgccaaatacatatttgtgggaaatgagagacttaaaatacataccaaccagagatatagttttgaggtagattttaaaattctgagaagaattttgactgaatttttttgacaaacatgggacacgaataagattataccaaagatattataactttcattttaaatatggaactaatacagtatgaggtgtcaacaacgttgaagtttcacaaacatcaccactacaacagcaaaataatttttgctttttccctgccacaatgacctccttgctatttcttgaataaatcaagcatacccttgccctgacacgttcttggggaggcctgccctaatctatataaaattggagccattcttctcacctctggtattcccagtctccctactttttttccttctttctttctttttctttttctttctttctttccttctttctctctttcctttctttcttttcccttccttccttcctttctcccttccttccttcctccctctctccctcccttccttcctccctttctttctttctcttttttctttcttgcttccttccttccttctttccttttctttctttttcctttctttgccaaagtgttattcacctttaaatataatacataatgtgcttactttaatgtatgatttttattttatttctcccttctagaatgtaggcaccatgagagtgaaatatatttattttgttcattgatatttcacaagtgtctgggagagtttccaacttacagtagacaattaacaaacatttattaaattaaggagggaaggaagtgagtaagcacaacaactttcatttctgggtcttttataatcatatgcttagtataagaacagtgctattcagctatccaaaagttacaatcaaaatgattttggatgaatatcttgaaaattgtgagaaagaagttttatttgctggcaaactattctgggttgtttccacttcatgtaatcctaagtagcagccttaccttgatagcccattaaaactctgataataaaaaggcagaacaaaaatatctgtgatatatttagatttactacatgtacttacatgtctagtgtctggtgcaatggatgctaatgatggcaaatccttactgggcttctagtgaagttcttcagctaatgtttgaatgcatggttggtcatggtggtacccctttgtacaaaatatgcttttcaaataatcttattagggataataattatattaattcctggtttccatctaaaattttaattctatttatagcttcgtaagatttcacaagttaagagggacctcagattaaattagtacacaggcaattaatcagttttgtgtctccgacccttttcacgggctaatagaagctatagaccctcttagcttcagaaaaatgcgcactcacatacgcacatcaaagagcttaatgggaagtccattgacagaccctctgttcagatcaatcttctgattgtagagatgaggaaacagaaatctacagaggaagtgggtagtccaagattgcacagtcatttggaatagactggacaccagtagtacttttccagccactatatcacttccccaagcacttcctcaaaacttaccttcctttgggtctttatacattcagttatggacaactagatttaactagaggattttattgcttcagaatattaagcaacagggaaacatgtaccgtcttttattcacctgcatttaaggcatacaatataaattgcaaatggagcatgaaagtgcttaatcttttacaaaactgggtttgctttccacccatctaaaaatacttctatttattttaatatttaaagcagaaatctaagtgatgtgacaaaattaatcatttggagatatttcccttataggtagtatagtttcttactgatttctaatatgaaaatgaagccatagaacctagaaattgcagcatagttgtggaaataaacattggactgagagtgaaaatggctagtcttcctctctgctcatacaccacctgactggataacctttcgcagatctcctaaaagtctttctcataaaatgaggaagctctactagaaaattgttgaagtctaatttagcaataaagttctgagtttctataataattcaaagaatactctaataaatgtctgcaattgtggtcacatctatgggatgctaaaaaatctggatggtttcaatgaaagtatttaatttgttcattatgaactttgaaataatttatttcattttttaaactttgatcaaaatgaccctggtaaatagaaataagcaaactctttttgcttgaaatgcttattaatgactgcattgagacactcattcatcattcaagaaagaatgtttgctcacactgtgccagaaacttggaggaagagggatgtgacaagtaggggtactggatgtctagcttgtagaagtggattaatggctctgcttttaagatcaggaacactgaaagggagtaatggcaccggttttcacctttcatgccctttgagggtatctggtccatcaccctctagttgatgagggagggaaagttccctctcccttcacaaataggtggaaattaaatgacataattctgaacaaccaataaatcgagagtaaatcaaagcagatacctgttttgttaatttgatcatatgaatgtagctgcccttagtaataatttctaagtataagactagttaaaggacaaatgagttatcttgaattataagattttgttttacagaacaatattaactcttgtgtttagtacattagaataatagatcttttgatccatatttttactcatgtgcacataagaagttatcagtcatacaattcatttcttgaagttcatacctttcattggcagagtagaaacaggttaaaagtgcacaggcagaaattttaagtgcaaagcaacagtgatgttatatagagaaaatttatatttcctacttctattgaagaagaaagatctgcttgttctaagaatattgtacaaagaaagtgacttgaatcagcgttattctgtaatgctactatgcgtgcagtgtggagtagccactagaacacttggtctatcccagctcctcaacagtgtcttgcttgtggctggtgctcaaataaatccttgctgaactaatgagcatctctttcatgccacatggaatgctctaaaagagttggatcctgaagtttttatatttttgtaattttctggagttttagagagcaaaagtcctgaataaactgtgaagccactgcctgacaaataatacagcagtcagcttcgttatcatatcccattgagacacgacttatctacatgatgattaatagttttcacgcaagaaataagcttgaaatgtctgttgccttggatacttaaaacatccaggttcagcgatgttatttattgttgttcaaaatcagaatgaagttcctaagcaatgccattttggaaaaattacatcaatatattatgaacaactttttttaaatcttgatttcaaatggattgacacgtgtatattctgtaataatcctgacttaattcataaaaggatagctagccagttgtgtgctagatgaataaaaaaaaagcaggttttaaaatgtcaggtttgacattgtgaatataatatctaagtatccttttactcatttcctttgacttactatggctgtcatgttgggcttcatgaaaatttatttttaaacacttgagtgttatggaccctctgattaaatgattaatcagatgatgtatgttgccatcagctgaatcatttaatgttgatttcacaaacaagcacaggtcacaggcaacatttcagatttctttgaagaagcacacacaggtcacaggcataatcttaaaataattttataacaaggtagtaataagagatgtcaggactggagaaatattttaatttatagtaagctttccccttaagtgtctaataattgttaatataatacattgcctcaaataattaaaagtttggttcttgtccttgtgcttgacttcagaagataaccagatgactattaggtatatttagacctaaattaaaagctttgagacacaatgaattgcctgatttgtatttgtgtttcgagtggcatatactattactggcactataatcttagattaaagcatactgtgattattaaagaaaaatttaagattgatttgtttctaaaggtatgtaacagtgacattttgcaatgtggtatgtaaaagttggtatttctcactcatatgagagcccactaatggtacataaactgtccccacttagaaacacaattattatggcctttctttgtatctgacaaaatttcactgggttcaagatggatgaatagtgaattctaatgacccttaatcctgtaaggttctaggtgggaaagtactctgtaattatgtataaaattataaggaaaataggcttactgctatgttttcattaaaaatcattaactgagtacttaatatgtgccagacactcagctgggcaccatgagaaatacaaaactgagtaacatatgggtggctcctgccttcaagaaatgggcagttcaggccgggagactgacatatttaccctgggaaaaagggagcagctgtggtctctgagaacaatatggtttgttacaagtatatatccatcatggaaaaaaagagatttatcttagaaatgagagaggctgatgctctcaataaatatcatacattaaattgtgtttttgtcagtagactgaaattacctcacatacacgcacagatagtagccatgatattttagctgcttagatatagagacaaatacttccacccaaatcttaggatcagtggttaatagtctgtaagcattacaatcccacaacatatgcatgactatacatccaattttaatattcaaagaactgattgcgatgatagttttgtttgtcaaagaaatgtattataggatgagtgggatagaactgcatcacgttacaccaacaaataggtttaaatcatatttgtgcacttcccttgttccttcataaatgtttaacatagcttaaaattctgtggactgcaacgtgagagcaatgaccacacttctgtgaacccatttttactgtgcatgtgctaacgtctattgttagtattccttcacttgcaaagatggcatgataattttgctggtttcattaatgagatactgttaaatgtaggatgacttcaaacttagttgtattgtaaaattatttttaattgtatacatttaagttgtacagcatgatgttttgagatacttatctttatttatatatatatataatatacacacgtatataaaagtgattcctacattgaagcaaattaacatacccatcatcatatggttatctttgcttttttactatcagtgcctaaaatctactttcttgaaaaattaccagtatgcactacaatattattaacaataatcttcatgttgtacattagatctttagacttactcatcttacatgacttaggtttgtttttacctctactaccatctgagccatatttccactttgtaatttgataataaacttggaaaaatagcacttatatgtttaggtgacgggcataaataggataagatgtgtttatatattattccatatatcttgtctccaactacaatgataaacaacctgtttgtccctaaaaagtaagaaataacttgacttttctgccccttcaagcataggctgttagcttttaagttttagggagacattgatgatgctatttgctttatcaagaggaaattgtcaaaagaggtcttttggttctcaaactattcaaagtatttaaaaatcaggacaaaatatgtttacgtgatattcaagggtacagaaatgaggtaaatgagatgccaattgtatttgtcatgcaaatatataattacgtgtatgagagttagatgatacatctcatcaatttaattgttcttctacaaggagaaaatgaacaatttgtcaactcgtatatgaagtaatttttataagaaattttattaaaacttttaacaacatttggatttttaagttgcaatttaaatatccccttctaccaggtgattctggaatcactaagcagttacttgtgaaaattccaaagtagcatttaattcttattaatgtcatagtgaatactaatgcaaagaatactgagccagaaattatgcttgttgaataaatagattatttattgaacaagtaagtgaaaaaatggaaataaagaacggatatatattttatcttcctgcttagatgtgggactgtcctacttttctctggtgttcacaacaacaatatgataaatctaattggaattcagttcataggaatgaattcagttacattatggattgtgatgaataatgtacacttttaatttaatgaaatcaaatagattttaactatctatgcttacaatggggtgacataagtctgacaatccttaatatcaagtcatctccaattcacatgtatacacactttttttctatttggctattgggaatcctcacaaaaatcgaaaattgccctttcagtgtacgttacggtatttcatgccacacagattttctgaggttgtacatacagctttgccttgaggttccaatttttgctcagtggattgagtatatattatttgctatatatcagaagaggcatgtgcttcctacttatgtcaggtaactttgggattaatataattgtcctacaaagcatagatagatagaaatacttcatccttaatttctaatattatgacatatctaaagtaggcacctttaaaagttaatctccactaaatactaatgactgcttatagtggcaattcatctttcatggtagtcctcctacaaaggtatactaacatttatgagtttgaaacaaaggcaattcacaagtgttctgctagagatggtctatatctgctgtttgatccagcatgatggccagctggccctcctgtgcatgacggctcgtggtttaactgcaccattttgtttggtcatatacagggaaaacatggcatggtgtggagggcatgggcttgaattcagggaacagagagttggtcttctctctctcactctactggatgatgtcatctcccctctctaagcatgagttttcttatctgtgaaataaaaatgttgaattaaatgagttcaaaatgctttcagtctgtgtttaatagcttgaatcttaagacaatgtattcaattatgcgttgccagatccctggcaactcatgtaacctttctaaaccatagctactcatctgtaactggccagccaactgcccagggttggagtgtgaatgaaataagataatgcagacaaaagatttttaaaaattgtagtgcattatacagttgtaatattttgccaagaacttacattttctctaagaagtgtgtcgatacatgatcacagaaaatcttttccatattcctttgtagtttgatgatattaagtaagtaaattgtataacacaaagagggaaaagcatcactgaacatgccgttttatttagctaaataaaatgtaatcactattagttttcctctgatttccccaaagtcatgtgattccattgagtattatgcacatggtataattagaatggattctctgctcaaataattttgggaaacatttaaattaacaaagtttaaaagtatctctgttaagctgaagcaaatctcaaaggccttaatattgtatgtaagaggaatagttaccatctttcctaatgcctctttgacgccaaacccatggagaatagttctaggtgttcagtaaaacacagatttgggatgccacaggttaattggaactgtcccctgcaatccttttctctttttcttaataatggctgattgcaggtcctagatgaaagacatttagagagattatcaggactcagcatcccatatcagaatccattcttttatagtcattttctgttacatttcttgggacaacaccaaagaaatgaccatcttcattcacataggctttgtaccaaatgctgacaaagatccttggtgacctagatgggggcaggtctaagtagattgcagctgtaaaattggctgatgaatgatctcagccccttttactcacactcaaaggcaggacagtccattaaggggaaggagggcagagtttttccttaggccaattccctatgccagaactttttagaatggaagcatttccagaggagaaacaaccccaagcacagttcaaagccccctcctcccaagttcatttgaaagtgggatggtttatctgcaaagggggaaaagatgagggatagggacgggaatatccctacccttcagagagtctggtttcatcctgcacttttactgcacagccacaaatgccttggggtgaatctacaatatgatacatcatatggtctaaacgtgcctggctgatcctctctaatacttcaggggtctaaaagggataacatgctctcctgttactcaccgactctgtccgccatatttcacccagccagccactgccttcacttccgtccgaggcctaatctgagcccatgggaaacctaagaacccctaccacaactgcctcaactcttgggaatcagggtgtatgggggtgacaggaagtgagcatacattctccaacttgatatgtcagcccccacgtctgtatgaatgtttgctcacactgtgactgccggccttgctcctcaggctgcatcctaccagggagtaagacccaagtccttcctgctttcagacaacaccaagcctcatgagtccccactcagaggaaggaccagagacaaactctaatgttccactaatacttcccttcttattactttccttgaaaatcccttctccctctttctttttatacttcgctaatgaaaggtaatgaaagggtctggcacttggaatttagaattgatacatggtttttaacccgcggacgtattccacaataacccttgcatcttctactaagatgtgggctaggaagggaccagccagttcccagggtcacagtgcctcagctgatgtttcatattttcagcaactttatgttagagatgtccatcaatcagaacaatatggttagagaataaactaataaaagtcatttttgaggacatgttggaagtctatcaaaagcattgaaattatgcatgctctgaccagtcgcatgtctaagaatttaaatatgatcataagtttaaatatgaagatgtttatcacagaattgattataaaacaaaattgaaaaaaatagtgctagaagtttgatcatagggacctcattaaatgcattatggttgatccatgcagtggtttgctgaacagccattaaaatgttgtagaataattattaatggtgtggaaggatgctattgttgcagtatgtgaaaagaacaaattacaaagcagtttgtgcagcataatatttttattttttaaaaacctgtatgtggcttatgtacatataaagacgtggaataaatgcacaaggtactcagtttttctcagtgaagcccattttgcattttgggctgggtaattcttcgctgtggagaactctcattcattgtaggatgtttacaagccctgggccttacctctttaacgccagtaggcacccccagcatggcaacaagcacaaaatggtctctctcatattgcccttgaggaaattttgcaactaagtaactattactgggtcctagattacagtctggattattgcgttcctttcttatttttattttctccaattccctttaataagcatgtactggattcataaaaaaacaacataaatggtaattacaatattccgcactggttaaaacttatgtaaataagcattctgctgctttagccacaattgcaatttatgctccttctctttcttaagttcccagttcccacgtacattcattcgactgattcaaaagtcattttagcttgatagactcttaaaagttagagttatcatttctgctatttattctttcaattatccatttgtccacccatccatctgatccattttgttgatgcatgctgtgtataaaatactacaccagcctggtgcggtggctcacgcctgtaattccaggactttgggaggccaaggcgggtggatcacctgaagtcaggtgtttgagaccagcctggccaacgtggaaaaaccctgtctctactaaaaatacaaaaattagccaggcatggtggcagacgactctaatcccagctacttaggaggctgaaccaggagaatcgctcgaacccaggagatggagtttgcagtgagctgagatcatgccaatacactccagcctgggtgacagagcaagactccgtctcaaaaacaaacaaaaaaaatacaatgccaagcatcataaaaaatatagtgatatataagacctatttgttgtgctctaggcattgacatctagctgtcaaccattaatatgtgtaggagtctatctatcaatattatggactgtgcttgaagacttcttccccaatctttttctcttcccattaagtttgaagtgaggttttctgagtgaagtatcatagtacatacagtctcattatttttcaaaaatctctggttatagtacatttctttcctttatcccctttgttcccaactatcaaaccattttggatatccagtattggtatccagtattattaaaaagcaaaacagagaactattaacaaaaaaatttgtaggagtaattggttgtatggtatccagtactattagatagtaaatcagaaaattattaacaaaaattttagacgaataatggattgtcttgcccaagtgaattgagtgatttagttgttctttcatttttagcaagtacagctgatcatttgaggccttactcattgtttgattttgcaaattcttactattataaatgttttgggctctgagaaagctgttgtcttaatctgtttgtgctgttataacaaaatacatgagactgggtaatttacaaacaacagaaatttatttctcatagctctggaggctgggaactccaagatcaaggcatttgtcttcaggttcagtatctggcgagggccggttctctactcccaagatggtgtcttgtcactgtatcctccagagggccaaatgctgtgttctcacatggtagagagatagaaagggccaactcactccctcaaggcctttcataatgttaccaattccacttgtcagggctctgcccccgtgactttattacctctgcaaggccccaccacttaatactatcacgttggttattacgatttatcacatgaatttcgaccatactagttgccatcctttcattttcatatatccttaaaactttgcctttctcattttaatgtactttatccacagtatgccaacttttcgatacttttgttaacctgtctgacgatatataggaaactgtaaaagtgcagtttttgatacactctttagctgcccgtttacttctactgtcgttagagaaccccatccatagtgcatgtgtttattttgtgtatgaacaaagactttatatatagtttgggtcatttttattcattagtgcttcccttataatctctgaataccattttattagtacatactgctattcttaatagtaactagcatgcctgatcatcccaaatgtctaggttcacattttaaaataagttatatctttgggcttaacagtttattgaaaggtaacaaggattgagtcatagttgtatgtttttggaagtagaattcaactgtaaatagaaattggttgtttagatctcactatatatgaaaaaatgaaggctttaggagaaaatctccccaaagtacccatttttcatgtgataaatatcatgaaatgatttgagaaaaaaatgtatatttgttacagctaacaaatatttgtgttttttattcttcatggagagaatgaaatttcttctcttctttacacatttctttttcttattagaaactaattggtgcctttataaaaattaactgcagagcactaacgtgtatatataagtattatgtagggtgtagggtatgttcagggtatggtgtgtgtgtgtgtgtgtgtgtgtgtgtgtgtgtgtagctgtgtgtgtatataatgaaatatatggtagtgttgtttcagaaatctgcttggtcttcccagagttcattcatcttataaattcatctacattgatctctatttttggaatccatgaaatgttttttggcagtacttcctttaatatagtgtgctggaaatctggaaatttctagccagattagttacaaaaaattagccagtggttttgcactctctatagaatcaaggcccaaggcctactcttgttactcagggccttgttttatctggcctctttcttttcagccatatagctctcaaatactcaacaaaattcttcattctaggtagacaagtatcttcaaaatacttcccaattatctaataactgtcttaccactaagaaggcttttatgtctcctgtctgaattttatccatgcaaaaaagtccagcccaagcctccagaactccaaaaagttatccctaactgctgaaacacagtaatttcactatgtgaaatttcactttggtctcctagcatttgcagatataccatacatatccttgatccttttcctttcataccttttatatctaacccttaagctaataattttacctacactgtaattcaaaatgtatccccagtcttaccatgtctcccttctctactgttaccaccctaggctaggccttcatcatttctcacctggactccttccctaacctctgaactgatctgcctgcttccacttagacacccaacctagtccattcttgagcagtcggaataattcttttaagaaagaaaccagatcacatccccctctgctcccaaccatccagtgacctcttatcatacatagaatgaaatgcaaatctttactgtgttttaaaggccctacattatctggacctcagtaacttcttacttcctatcccttttctccttgtatgccaccctccaactacactctaactacactgtctttttccctgttcttcagacctgccaaccatattttcactgctcaattaatatgtagaaaatgaattgtttgttaaatgtagactgtttccttcttaaagcaaagataaatgacattgtcttcaaaaacaactaactgcccagaattcctgattttaattttaaaaagacaaactgcaagaatgtgttaaacagtaaggaaacaattcactacttcagaattctatatgatttcactgcacgttagtaattttgtatattatagaatatgagggtattctaataaacttaactctatgctgtatacttatcatgatagctcattttcttatatgtttataacagcactacttattgtacatggatacgtgggaaataaattaattttctccttaagaacaaagcaaccatttcactcatgagataaatcttgaagatttaaaaactacttataattaattatacattattcatataatgttaagtattttcttagtaaaccacataatttagaatggcaattggacagatgggcagaaccacatgcatccactattaggcagttggtgagcataagatgccagaaagaagattaggaatatcaaggcagggagcttccgatcgctcttgaaaacattgacccttcactcctcactctccacgatgcatttcctttgaaaagtaatgccttccaaaacaaagttctctgttttatatctaaacttactcaatagtttctcatggttattgatatataaaaaataaagtaaaatgtttaggcagaccaaaagaagaatttccccctccctctgccttttatgccaaggtgacagctatgaaatgtacagtacgtttcctctgcaaggaatgtagcagtgttccattgcaagaagatgagagggagagaaaggttgcacgctgaggaatatagtgtcatttgtcactgcctagactcatcagctgtgtggaactctgagaggcaccaggcttctttatttatttcttcagaaacttcagcaaaaaagatttcattaggagcagagaaaaatgtgaaaaacgaattagcttttgtgatggggagtagtcatctctgaatattgatcaagattaagagggttgtcttcgtaacttcttttatccatagtctatactgatttaactagaaaactaatttcaggtggtatttcgggtgtggcagatctttatagtaaatgaagaatctagtcaaatctactgaaaaactctgcttactttaatgtttgatctggttgaaaccattttagcttaacaatccttcctctgaaacagggaatcaattgatatcctacagcaaaattatgtggaagggccattagcttcacatccaatgcaaattttgcctgtgtttactcttccccaatccaaaatatatcagatcctagatgccagtgaaatcgtttgagctagatggcttgagggtcatagcttttttcatttcctgttctcagacctcttataattgatagaataaaatcagaagagccctagagctgtcccacctattctgcctcacaaaagtagaagtaatggcaaccactatcatagggatcatgctcacctttttcttaccagacaaatttggatattagcttgaaattaataccttccttaaaatgttggaatttggttatatgcgaaattttgctctatttattcattatattttgtatggaattatttttgccctatattttcacttaagtgttctctacccaagattttaattgaacccaaatcagccagacacacagacatggattttgctgccaccaaggttaattcttcttttaaagttaacttttaaaatttggtaaaatatagctttgaaaatttgcattcgtctagtgtttgttatgtatttcccccttttgtttgattatatgtctatatttttcttgtagaaattgatttttaacctgctttttatgttagcttttatgagcttctgtctgaattctgaatatgtctttcttaatgtcttctaaatgtttctttctggattattaaaagatttattaggcttttaataattatatttgttaccttagggaatgtgtttgaaaatattttaaatggaattgccagttaacacagcattgaactttttcttgttagagatacattgttttctaggcattttattgggagagaagttagtatgatataatgtctttggctgatattaactcttctaagatgcattgtttctgagaacaccattgtctgatttcattcagggaaatttcacacaagccagtagagtcaatacttttttcaagacctgttaattgatatatataaaaacttgccattgtttacatgcccatttcagatcctttatgtgacctaagctagaaatgcattttaacagcatttgtttttccaaaaatatttatttatttatttattatagagatagcgtctctctatgttgcccaggctggcctcgaactcctgggctcaagcaattctcctgcctcggcctcccaacagtgctgggatacaggtgtgagccattgtgccaggcccttgtttttattttttttgaacattgtattttgaaaggggtttgaaggtgatccctagatagcaaccagtaatgattcgagcagcaaaacaatctaaaaagtaattttataagaaaatgcagaacataaatgagcccataaaaaattatattaggttctatttacattactaccttctttcacatgtaatatttcactaacatttaatgaatttctgtgcagtgccatataccattatgaattctaggatagaagaatgagtgagaaatgttcttaggccttaggaagaaggaacaagcatctctgtgtaatagttatttcaactcttcttttacacctcattcccatattaaatctcagaaaagctaaagtaatagctatcccagatctattttagactccagacacttacttcaatgtcttgttctccttatcagactggaatcattccaaacctcttaacttctgggcaaccatgataatgcgacagaaaggacactaaatctgtcgcaaatttatcttgatattctatccagtcttacttggtactgaaggtcacaagtaaaataaggtggttgttttttgtttgtttttttttttttgacagaagagaaaagaacactgtgagcacagagtgaatgtctaacattgattcttgagtagcaggaattctctatgcgagaggatctctatgcaaaaagatctcatattctagcacaatttaaggatctctatgcaaagatatcccatattttagcattatcaataagctatggggtaatatattgtatgtggtgtggcttgaattctagaaatttgatttctagaaatggtccctgtagttaaggatatataatgtggccgtctccagttttctatgaggaataggaaaatactatcattattagctgtgtgaccatggacaacttgcttcgttcttcagttgcatcatctgtataaaataagaataagaaaatttacatctgcaaggtgtgatggagatcacatgggataattgtggtcccagagcctggcacaaaagggcttaatatttataatcctccccatttctccgtatactctaaaggaagtttattgcttatcaaattgtgccgtggttagttgtacagcttccctgccaaattgtaaactccaacactaatgtgacgttacattttatatagtgctatgattttcaaattgtttgcataatttcaaatacacagtaaattgctttttattagtataattattgctattgtcaatattattattacaacagcttcacagtaagatgggcagaaaaaaatttaatttccattttacaaatgcacttttgaggctcacagaagtcaaatagaccaaagtcacagggctagtgagggacccagaagaaacaaattgtaattcactgattccaagttcagtggttgccttactgcatcataaaggctattacacaatccaggtgtatcatatgattcttgtctatatattcatacatatcagaaaaagtgttctactcaaaattgctagcaatcaacagatactgatagtcattagtacttaaatctttatcaaatgaaatattaatacccatgaaagagaggacaatgaaaggtttgtatcatttgtatgtcacaagtcaacttttttcaatcactcattattagtttaactgtaaaaaattatttacatttagcgtgaaactttcctgtattctcaacatatttccttcggtagaaaagcaaacctccagttctctgttctttgcttggatacttgccagtttgtaactcagctatcaaacagtaaagctcacaaaacacttattaaaatgactaaaatccaaaacaccaagagcacagcatgctggtgagatgtggagcaacaagaactttcattcattcactaatgctggcaatacaaaatggtacagtaactttggaagataggttgacaatttcttacgaagctaaactatacttaacatatatatttgtccattttcacagtgctaaaaagaagttcccgagactgggaaatttataaaggaaagaggtttatttaattgactcacagctcagcatggctgaggaggcctcagaaagcttataatcatggtggaaggagaaggggaagcaaggcacctacttcacaaggtgacaggaaggagaatgaatgcaggaggaactaccaaacacataaaaccattagctctcgtgagaactcactcgctatcatgagaacagcatgggggaaacagctctcatgatctagttacctccacctggtctctcccttgacatgtggggattatggggattataattcaagatgagatttgggtggggacacaaagcctaaccatatcaccatatgatccaaaatcatgctacatgatattcacccaaaggaaatgtaaactgtgtccacaccaaaacctgcacatgcacgtttatagcagctttattcataattgccaaaacttggaagcaaccaagatgttcctcaataggtgaatgaacaaaaagactggcacatgtactcaatggaatattattcagtgataaaaagaaatgagctatcaagccacaaaaacacatggagaaaacttaggtacgtaagccagtttgaaaggttgcattctatatgattccaatatatgacattctgaaagagacaaaattctggagacagtaaaaagatcagtgattgcctggggctctgagaaagtgcagagggatgaatgggtgaagcacatggcatgtttaggacagtgaaactattctctatgatactgtcatggtggatacatgaccttatacctttgttaaaactcagaattttacaatacagagtgaattctaatataaactatggactttagttgtaataaggtatcaatgttatttcataagttttaataatgtaccacactaatgcaaaattataataataggggaattgggggaagggtaatggagtatatgggaatgcactgtaatctcagtacaattattccacaaacctaaaacttctttcaaaaatacaagctattggtcaggtgtgatggcttataccagtaatctcagcactttgggaagtcaagaccctcagatcacttgaggccaggagttcgagaccagcctggccaacatggtgaaatcctgtctctactaaaaatacaaaaaaaaaaaaagaaagaaagaaaagaaagaaagaacagaagaaataaaagaaagaaaggaaagaaagaaagaagaaaagaaagaaagagaaagagagaaagaaagaaggaaagaaagaaacagaaagagagaaagaaagaaagaaaaagaaagaaagaaagaaagaaagaaaagaaagacagatgcggttgctcatgcttgtaatcacaactactcgggagactgaggcatgagaatcgcctgaactcagaaggtggaggttgcagtagggtgagattacgccactgcactccagcctgggtgacagagcaaggctctgtctcaaaaaaaaaaaaaaaaagctattaaaaatatgtaaagctcagtctagatacagtaccagaatagtaggaactttatttcacctgtcctacaaattatggttgtgtgccacttgggtaaaactcagaatccaaatatgtgaatgtaagatttatggggaaattatttgtatttcaaaataatccttaatgaatgcactccttctaaagtagccattaataaagcagttaatgtttcatttaattatagattaatgtacataagatatgccaggaatgcaattaggaactgggaagggggtgttattctaataacttccacatagcattgtgagacattttctgctttcttcaaatttcatttaattacattttaaacaaatatttttgtgagcctattatatagtccttcgctagcactgaggagacatgctttgtgaccttggtgatttcacattcaaatttccctttcacctacactcttccttgttttttcatgcctgtgtagattgtaaattcttcctcagattaagacattttattcacctttgtaacatccacagtatctagcacaatcagtgccttcaaaaacaattggcctcaagaattgattgactcaatgagtgactgaaagactaaattaataagtacacatctatttgtacttccctgcttacttataaggtatgacaatgaaatactgagacagttatacattacttacggactcaatctcatttctttacaatctctattcttcttttttgagtataatgttattttacaattccactaacttgtcactctttattataaattcatatctccatttcacctgagaataataaaggcaaggaagtattttaaatgatcttgttttttataactagcattcattgagcaaatcaaagtatgaaaataatataggtgtcagtgattattataaagttgtatgcacaaaacattccaatgattggggccaatacagagaaaacatctcaatatttggaattttgcttttctgtaaatactttgatatgtacttacatcatatcaattataactcctgctgaaaacaaacagtgcacacaaatttggtagttggaggagactttataaagggactaattacgaaggtttagaccgggttaggaaaaacacacggaatagtgcaatactttaggatggcaacagcgagcaccgttataaccactaggccaaaatgaactaaatgaacagggagattaccatttatcagaaaaagagggagaaaggaaggagagatgaccaagcaagtcctatgtgaagacggctgcctgacttgagctgtgtgatctttggactgataccacctgcctgcactggcctagcagggcgagaatagtcaatatctggaaaatggatcacctgaccttactttcctccctccctgtttcctctttgtggtgtttccactggccaaactcacagcgtagacaaaaggagtgcattgatgtagcagtggttctaatccagggccaattgtgctcccagggaacattagtggttatcacagctcaggggaggaagggagaggagtggagtgctactatgattcactgagggatttttttaaacatctacaatgcacaggacatccttccacaacaaagtatccagttaaaaaatgtcattactgccaaggttgaaaaaccgtggtgtagtcagtacaattcatcttctccaggcacagtgcaggagtggggtggagtgtctgaaggggaagaaggaagaaaccagcacaccccacaaaagtaaccaatgcaaataccaaataggaaaagacagcacttaaaatacaaaagtctcaggaatatatctgatagtgttttatggaatttattaaaatttagcctggagtgagtaatatttagcaagccaggtttgtctttagagaaatccttgtggggtttatacaaggatttattaacaaagggcacacacaatactcatattacagtcagtctggttatgtaaaacatgggcaagaatgtaataggacaatgtgatgtattcacaaaggattttaggactacacagataatcctctaatgctttcacttacgtactatgaaaggctatagtttgcatagtgatatagccacgtaagatagtaaacttgacattcatgcagctatacatgtttgcacacaccaggatgcatgccctttctacctggttgattttttattcttttattaatctctaatttattccccagaacactctccataaaaactttctcacaacttaaatctttaatctattgtgtggatttctgactcattctccaagcttttcctcttccctccgcaatgccttatagtcttatgactatttatccctttgcctacatttctagccagatctcttgcctgatacacactctcatatttctctttgcacgctacacatttttatttagatatcacactactactttgatttcaacaggtctcagtttaacttaatttttccttcaagcaaggagtcccttcatatcagttatcaccattggcaccagaatttttcttatgacttcccatgacctacaatataaaccatataaatcactgatgcctccatagttccctccctctcaaatttagccataagatgattttaggatccttgttttttccaatctctctttcattctctcccccatctcttccattatgaaggtttggataggacacaactcatgcctagattagtgcaatagatgctgagcctgtgcagcggtagtttagctttctctcctggttaactttaactgccacatatatcacttcacacgtcatttttcattcaaacgtatttaactggctcttcattcataagaagctggaatttgtcgtttgactgatattttaaagattttatattttttctccatcctcgttctaatgttgtatcttgtgtcatttgttcattcataaacttaagacttagctaaccactgagcatccaggaaattcagtatctatcatgtgaattctctaatactggttgatccattgtcaccagagcatagcaggcttctcctgcctttatgtatgtttgtcatatagttcatgcctaaaattctttcttaaatcttaaattcctaagatacacacttttgcccaagatcacagtaatctctgccataatctctgctggaatctgttcactgtgttgctcctgctaaacttcttacagatgactttttttctttttggtttccctggtatctagtataatttcttatataggtactcaataaatgtttcctgttgatctctacacctactctgtacaataccatagtgactagacacatgttgctatcaagcatttcaaaagtagctagcctgagttgagatataggggtaaaatacacaacagatttcaagacatattatgaaaaaaacccataaaatttctcagtaatttttttatagattacatgtagaaactataacattttgaataagttgtatcaaataaaatataaaattcacccggttctttttaatttgttaaatgtggtggctagaaaatttaaaattacataattggctcacagaataattataatggatggtattgctttagatcaagtttgtctaacccgtggcccatgggccacaagcggcccaggatggttttgaatgagatccaacacaaatgtgtgaacttccttaaaacattatgaattttttgtttgttttgtttttgtttttttctcatcagctatcatgagtgttagtgtattttatgcatggctcaagacaattaattcttcttcaaatatggcccagggaagccaaaagactggacaaccctgctttagatagtaaagcatatgagtagttaatgtgtactataagcagtgtgatctgatagactatttaatgttgtttgatggtacattattcaagtcgattattatgtctacctatgcagtttaacgacggtaatgagagagggcagcttgattacaggtcttatcttttgactaacttgctaggccacctgagaaggacccaaattatctgaatgcttaactcaactaatttgtattcacttgaagaatttcaaggatgtttatatgccatcaacttgctttaaattttttctctcagtgaaaatttttcttaaaatgagtatgtggtattcaaatttatccttgttttctatgattatcttttcatagcactgtggtttccaggaacctttttttttttgagatgcattctacatgtaactattgcacagtttgcatgtagtaaggttcattattcttctacttttccaaacacctggcatgtttacttgaggttggtacaccttgtatcccagattttgctgtttttaacttaaatattgaatattttgattaaacattatggaaagtttaaatgggtcaagaaaaatagcttttcttcccatgaagaacaatacggcataggagttaagagcatagatttaaagtcagaaaacctgtgctgcctacttgtgcaaagtcacttacatgctgtacttctgtttcttcatctgtaagttctacccctaggtatttacttaagattaatggaagcatatgttcatacaatgacttgtacagaattattcacgatagcattactcttaatagctctaactggtaacaacacaataatcaatcaacaattgtgctgtattcatacagcagaatactacttagcaacaaaaatggaatggactactgataacctcaacaacatggatgaatctcaaaactatcatgctgtgtgatgccaggcacaaatcagtacatactataattccagaaaagacaaatgtcatccatggtaacaacaagatccatgcttgctggaggtagaggcatcagttcagtcattcaggaagctgattccaagatggtgttagaattacaaccatccacaagagatttattgcaggcaatagctatgaaaggtagaaagagaacaggagaaaaaccaggcaaggaaaaaccacaatgtagttgtgatatcacttcaaagggaggcagaaggaaggagaattgggtaggaatagccacagattacagtgcagttacaagaaagtcttggcttccaacaaaggttacttgttgaggagtcatgcattaggcagacatgtctgggctgtagtttccttgctgctcccagtcattggctggaggccagtctgggttcctgtgctgtggtggatcccattgctgctgcagcaggaggccaatagcactcctggcagctaattggagagaaaagatccaagaggtgtaccttcatggctacccccatggggctggggtggaggtggaggagaaggagaaggaattaactagaaaaaggcacaaaggaaaattggggaaaataatgaagatatatgatttctcaattgtggtggtcgttacatgggtttattaatgcatcaaaactcaagaaatgtacatttaaaatgagtgcatatgattgtaagtgaattatacctcaatatagttaattttttaaaaatcatagatttctttatatttaatgcatgaacataaacctaagacactcctccactccaaaacttaattaccttgtgatcagcagagcagaaggtactttgtgatatataggtagagaagatgaagtcttgtgacatttaacaagggacaggaaaatggaccttgtcctaagttaccaaactgcaaaaatatcacctacaaaggctattcataacatacattttcaagggggttacaatatttgcctactataaaattttggatctgtaaaggggttaaattatttgtgcaggggaataaacatcaaagaaacattaagaggtccagagaagtaaaataggaagggtcttttggctagaggagatatttaactttcagaacatgtggaattaagttgtattgattatgatctgatcttcttccccctaaatttgatcctcttcctgtaatctattgtttccatcatcttcaactcttccctttccctctcccttgtccctcagttctagtcaatcacaaagtcctacagtttcactttctgtataccttatttctggaattcatctctagacttcaaaatatatatatatatatttttttttttgagatggagtctcgctctgttgcccaggctggagtgccgtggtgcaatctcagctcacagcagcctctgccacccaggttcaagcgattctcctagttcagcctcctgagtagctgggattacaggcatctgccaccacgcctggttaatttttgtattttcagtagagatggggtttcgccatgttggccaggctgatctcgaactcctgacctcaggtgatccacccgcgtcagcctcccaaagtgctggaattacaggtgtgagccactgcttccagcccaaaatatcttaagtagataattgcacgactaatctctgcttttctctcccagcagccttccaaattcatgtctcacagctgacagagttgttcctgccttcagattcatgacctggctctgtgttctagctcaggctttctctctcatatcacctcttgcctctctgttgcccccatattttcccctctggttggttggtgctcctttggaaccctctgcatatcttttcaagaatattatgacttattatgcctataaactttgtttaattatttatttctaaaatttgacagggaactttccgaaggcaggtattgtgtctttctcatttaaaagcaaattctcgcctggcatggtggctcatgcctgtaatcccacactttgggaggctaaggtggacagatcacttgagcctaggagttcatgaccagcctgggcaacacagttagaccaaaaaaaaaatatatacgaaaattagcctggcatggtggcacacccccgtagtctcagctagtctggtagctgaggtgagaggatcacttgagcctggatggttgaggttgcagtgagctgtgattgtatcactgcactccagcctgggcaaaaaagtaagatcctgtctcaaaaaaaaaaaaaaaaaaaattagtgaatcctcagtgtttaaaaagtccataaacatactaaacatagaagacctccaaatgaaattaatcaattattatttagtgggttgcttctcttttgttttaatatagttttaacaaagagtaaaagttatgatctttttatatgtaaaataaataatgccgggtttgacataaattttaggaaaactagagacgctacttcctaaaaattttctttctataatcttcctaaatatttttccataaagtacaaaataatagaaaaaaattaagagattgagtatcctttcaggaagtgatatgacaaatagggttcgagaactatttgaattctcaccacttttcataagggcagatctcaagttaaatttttctattcgaatttaaatgactttcactggaataccattacagaaaagcttctgtgtttagatggcaatatggagtttcttttcttggaatattaattgaaggagaagtcttaattttttaagtctatatctccgtatatatttgaacctattttatatgttagtccttctctttagtaaccttcatccacagtgaacaagatttacccttacctttaagcagtagcggctactttatgtgaagtgaacagctgctttttttatctgcatctagacatcaagtagtccagagtcctttctaacaccctagcaatagaagtaagaatattttgaccattccatgacttgatgatacttctagtaataatactgtattattaaaaacaaacaaacctttgtgcagtggtaattgaagcagttccttgggaacatgtattaagtactttttagcagttaagtccactctctgtaggttaaggaatatttaaataaaataatgtggcaaatgagttcaagatgataaatgcgatgagaactaaaacagctttaattttatgtgggaaataaatagaggaaaagtacattacagggctcctggacttatttctttcttcaaagtgtttctcctagcgaatattattactattttttctcttaagtaaaaaatacacaaagtatgaatctacacaggataataatattgaagttaaggatgatgtctcctccttcactctccaaaatactatttacttggcttcatggaaatctctctcactccaattccaccgtgtcaactgaggtcttctgttctttctctccctatagcatattcctgttacataaatcctaaactgtgtcgtgttagtcacacactgtaacctctagataagcgcctgtccagaggttctcaatcagagccttgcaaatatgtattaaatcaatgggtcatcttcagtgtctcagtgggcccttggatatgttttgcagactgctgtgagtatgtagggatgtccagtatcgagggaagtgtggatggctttcattggttcttatagggctgaagaacacatagagcagtaagcacttctactgtagggagagatcgagcttctcccatccccactgctggcaccaccaccaccctacaccccattttgagttctgaaagtgaatccttgagaaagaacacacaaaacaaccatcataatagtgggcacagctgtgggtggtagaataacattcccaagcttcttttcctacacatgattaatattaattcagcaaacatttattcagctcctacttttaaacaggcactattctaggtactaaagacatagaggcaaagcatacaagactctgcctttgtgaaacaattaagaaataagtaaaaagaaaagaaacagaaaaggcaatttggatagtgtcaggtgctataaagaaaacaaaatgccattttaataaataataataatacaatgttttcatactatgtgctagacactatgctagtaggtatttatagacataacctcaattaatcctcaaaatggcatgttgatatcaataccccaagtttacatatgagacttaagatgtctgagtatattcccccaggtaacaattaatatgcacaataaaactttttgctcattcatttattaacctatgttgattgagtacctattttgtgtcaggcatcattttaaggcacctggatatagttatgaacaaacaaataaaaatctctgccctcaaataattaatatctcacagaggttaggcaaaatataatcagaaaataagtataacgtataggatgccagatcatgaaagaagctatgaatggcatcaagaagctggaaaaggcaaggagacagattttctcctagagtctccaaaacagaacacagtcctgccgacaccttaactttaggctagtgagacccctattggacttcagacttacaatcccacaatgtaataaatttgtggtaattcagtaggggaacaatagaaaactaatacgatatcaaaacaaattatatcatagaacaagaaaatgtaattgtgacaaataatacctacaaaaatgttgtaaatgctaggcaaataatgtgtttaaagcacttaggccaatgttcaacgtaaagtaattcatgctataatatcatcatcatcattaccaatatttaggggctctaacaaatgatgtacgtgtaagcagatgtaagaaaatttccttgctgaagaggaggtattaatagagtatataacaatagataacaaattccaaataaaggcaaactaaatgttttattggattaaatttaattttaaaaactacaagaggccgggcgcggtggctcacgcctataatcccagcactttggaaggctgaggtgggtggatcacgaggtcaggagatcgagaccatcctggccaacatggtgaaacgctgtctctactaaaaatacaaaaattagctgggcctggtggcgcgtgcctgtaatctcagctatttgggaggctgaggcaagagaatcacttgaacaaccaaggagtcggaggttgcagtgagccaagattgtgccactgcactccagcctggcaacagagtgagatcccgtctcaacaacaacaacaacaacaacaacaacaacaacaacaacaacaacaaaactgtgagatccatggtgggcttttaagaggaaaatgcaagctaaggtttgtttagactctgagtactgcatgtgtaaaaataaaggcatgatgaaaagatcaagagattagagtgatactttttatctactagtgtcagagtcatgaccaggggattggctatgagaatacataagctgtgccaggagtaatccaaggagattgtttcaatttggaagagtgtccacagaatgattctcatactagacgttgggctattgtaaagaaagttggtaggtactccatcgctaggatcatatcagggagaaattgaacaggatggccctaatgaccctgttgtacccctagcttatggattaggcaagtcacttctactcgtataccctgtttccccatttgtaaataagaggatgtgttactctaaggatctctaagattctttgcagttgttaaattgcatagctctccactgattccatggtggaaatttgctattctattacaaatattctaaatgtatgagatatcagacatactcatttaaaaaacaaaatacaaaaaataagtattctacaaataaacacagataatgtttaaattctatatgtctttgtttctcttcagaagcatccaaaatacaaaccatctaagaggcaagaaaatgtcgtgatgttcctagtgcaagttaaaaagatttgctttcctcaagtcggaaagcccttctcatttttgaggtttttttcttcttttttttttcaagtgaaagcattttggaggagtcaatatccatctttaaaggtagccaggtcacatgtatacatatgtaactaacctgcacaatgtgcacatgtaccctaaaacttaaagtataatttaaaaaaaaagaatttaaataaaaaaagaaaatcagagagaaaaaaaaaaagatgcatgtgcaccctgatactaccatccatagtgatacggtttggctttgtgtccccacccaaatctcatcttgaattgtaacccccatgtgttgagggagggaccttatgggaggtgattggatcatgggggtagtttctccatgctgttctcatgatagtgaatgagttctcataagatctaatggtttaaaatcatggcacttccttttgctctctctttctcctgccatgtgaggtgtgccttgcttccccttccccttctgctatgattgtaagtttcctgaggcctcctcagctatgcagaacggtgagtcaattaaacttctttctttataaaaaaaaaaaaaaaaaaaaaggtagccaggtaaaaattacttgtttccaggacattttcacctgaaagaagcattgtcatataacatagaagcaagaaatccagtagtgggggttatttaaaaatagctggaaaatttcaatcagcatgagtttgaagcaacaatttatcatcaccttttatggtgggtggggttaagaacatttcagcgggcaaagtggtggtgatggggaagagacaccaggggaggtgattcccattgcattgctttgtaaacagaggcacaggttcttcatttttgtcacacaaaatcacagctatgcagaatttattaatttattcttctgagacaagaaaaaagccaccaaaggaaaccaacagcttgctcctctcacactgggggaaccatatgagagacttatctatccctgactttaattttgacctgaggagagctcctcttaaggaaaacaaattaattcaatgactatactacttaatcattgacctttatttaataagagatttttccataggatatgctgagctgtctcacttacatcagttgtgtctcctgaggtgggtgacaggagaccacaaatattgcatagcacacaaatcgttaatagcagctgtataccaaaccattacctaaatatgtagagtacaattcattctcactaatgtcagagagcatgctataaaatggtgaatccggacagctgaagatactgaataataacctctattttgaacaagtttacagtgttccaatcagtaattaaattgatacctgatgaatatatgtgtgtgtatgtattcatagcagagatggttttcctgagataaggattttgttattcggataggctgctgctggaattgtccttctacccttgtttctttgtccttagtcatcactcatacctctttccactcttctgccatcacttttgtcaccaaagtcatggtcctttccccgccgattgctgctgcaggtctagggcaccaagacttaggcagcactcaccatgtgccaagaactggaccacaggtaccatccagcattgctcatggagactctgtccctttctgtaggacaccctccttttagctagcaacccctccaccacctagagcctctggacctctcattttaatattaagaactaggaaaacttaccgctgagaataactagtacaactagaactggtagagaaatctgggtctcttgggaatggatttttaggctttattgattagaggtgtattaataatgcagtgttatagtttcatgacataacgaataaaaaagttcattttggacttgcctttcagctccctaggagctaaaagacgtatttaatgtaacttgtgtggtggaaataagttcttttttcaggcaaaagatgtgcaaacccatctggggaagaaacattaaaaactaaggagacagtgtcctagataactatgttcttttcctgttttagtctaaaataatgattagttttcttatatatcttcatttgtcttggttccttttagcccaatttaataatattattgcagatattgatgaaaacctttaccttcctcttaattcatcaaagtacttgataaaatttatacatagtacattaattgggaggtttttatgagattaattaatataatgaactgatgttgaaattatttaaaacctgaattattattgtattaagtaggacacttaatacagttaatcagttctgtctttattcatttgtgagaatttttggcaagctattgtgaatattcagggaagggaatgtatttttagcaggaatcttatacctcctacatagaaatgaagcatttactgaaacatccatgaaacaaaatgtttctgaatgtgtactatacacttgttataagccccttttcttctgtagctatattttggagaaaaatctttgctttgacaaaaaaaattatgttgacttacacatatattttataactaagcagtgtttggtttgtgataaaggatacaaaaatataaaaatgttcagcacacgtaagtaaggccttgttgacagtgtgagttatgctactggatactcaaaaggaacattcagtgttctcaggtggtctctagactgtctcaagcctaggaagatattttataagcaaaggaataagagaaggaagattcagatttaatccaagtgaagaattcagttttgtgtgccttatcctgttattttgagaggcagccaaaagatgctggtcagcaaggagaattgtaagttgggcagccaactctgatttctcaacctcttagctgttttcttaaactcagaatttttaatgaatttaaatgtccatatcaggtagactttggggatgcttttaccagtgattttcagaatgttactttctggcatttcttttcacgtagcattatattaaaaatgaattcattcatccaccttcccttgtccttactaattttccctcctactcccttcccccttgttcttgccatggggacatgcaaacactggtggttgatgtctgagcaaggctgctgacagggggaggaaggagatgtcaagcagaggtcaatggcagtgtgcccagcagcctaggaagtaggagggaaaagagagagagacagagatggtggatgaaagagaaagccaggatgattatggtggttatgatacttgtcatgctgaacacccaattgagcacccaataagcacataataatttaatcatcctctggcttggatggcagtgttctatcagtgttgacttcctggttgtgacagttttacagtgttagtgtagaagagaatccttgctttagagaggtacttactgaagtacttagggttaatgcaccattgtgctggaaaaagatacgcacacacacgcacacacacacacacacacactctcacacacacgcacaaatacatccatgtgttaggcagagggagcaaatgaggtaaaatgttaacaattaggaattctgggtgaagtggatagagggactctttgactgttcttgaaacttctctatacatttgatctgtttcaaattcttcagaaaatcaaactacaaaaacttaattcatttagtgaacatctactgaacatctgtatattaaatagtgttaaatgaatgtcaattaaaatgctcaaacacagtagaggttgattctcattcacataagtccatggtaggtgtttttggcaggtgggtgagtttctcccttagggagattgaggaacccagactcctcccaagttgcagccccaccgtcttctgaggggatgcatccatacccacttcgaagtagcatacattatttcctttctcattcctttggataccagccacaatttattcaaggtagacagaaaattgtagtatatagccatatgccctgacaaagaagggagaacagattttggtggacaactagcaaactctgatacaatctgttattaagcactgtgtgtggatagatgctaactagaaggagattatcttcccttcagcaaatataaactgaatgccgtttatttggttgaaactaagctagatcatgggagtatagaaattttataagaagacatagtcacttctgtcagtgagctcaagaagaattagtatgcggaatgtaatcatacctacagggggcttgtgccacttaagtaaaatgaaacattattttgagtacaatttagcaataaatgtactacgagatcattaaaaatcatgtttgaatgttattgtgtcaaggatgggaaaaagacttttgggttgtagacttgataattatagttaaaaacagtttttattcttgtttagtcttattttttatgtttaaacatatttatacttgctaacatttatacttgctaagtaaagactgtttttacaaccatgacaagaacaaaacatattagtaatgcaaatgccacatttcctacaatcaactaatcacactaacatatttgcatggaagaatcactgggattgatctggccacgtgtgtagtcatgcccaaaatgtgaagtccatctgttttgcaattttttttaaccactgttatccaaatgctccttggattttttttattagtggatatattttggaggtcagacaccctcttggctagatcatcacctttataacaaatatatatactattctcatggaaatatatttagacattgccctactgggaatttttttcaagtaattaatgtacagcttgtgcaacagcttgatcttggcttcatggaaataattcactcttagcagcatctaatgccacaaagcatttatggatgtcagctcagaacttacttttatttatctctgagttacttttttttttttttttttgagacagagtctcactctgtctttggcttgtccctaacctcttaacagacttaatattaagctccatttcactcagtcgttctgttgtcatataaatgagacattctacaagcatagtttttagtttctgccagagcatcatacaacattgtgagctatgatgaagataaagacctagagaagatatttaatatgaagttcattatctaatatttggtatgtgtggcaaaatagcaatctactgcttggttctgctgtaatctatttacccacccatcccatctttctttcaatttaaaaggataatgattttagtcacgattatacataaacccattaccataggcaataaacaatggggcaaaccattggtcccatagttggagtgtggtctgaagtgtgttttggtggagagagatctatgtctggagatagctaacatggatttggatcccagatctgctcctacctgttgctgtgcctgtgaccaaatcatgtgatctctctggtttcagtttacttgtgaataaagtaaataccttcatcaacacctgtttttgaatacaatgtttttctgtaatttttgcttcttataatgttataatgatcatccttacatctaaatcttggtttacattttcatcaattcttttggaaagattggagaagtaaattttggagatgtatgtcggctattaaaaatgtttaattttttaattaaaaattaaaacgttgaaaaatcctgatgcaaaataaatgcattatgcttagtgaactcttctcatttcgaagtttattcaccttcttgtttttgcaagtttcctgaaaaatgcatataaagtcactaagttagcagaactttataaaattatataactatatataatcttttgatatcagtgaagccagctgatcctatagaaataatgtaggaattataatcactagcacataatttaagagtcctgtggtcttattcatgttatttaccctctctgaatcttacatatagtaagagggttattatacataatatgtgtacatgtatacaggtaagtaagtatatatgcttatgtgtaaaagcagagttattgtgagagtcaaatggaaatgtgaaagtactttgtagttttttattactattattaatttttaataaaatggtaacattcatttaataatcattagttttaacttcagattgtactggatttcctctagtatttcttaagattagtgaataaagtatttctcctaataaatatattgactactgtctttcgatcaaacatattaggtatatttttacagtagcatcaggcagtgaaaatttgaagctctttatagaggactgatttatgatgaaaaggaataacatgaacaaatggaattatatgaagcttccccagaaatatctaagaggggccaattttaagaaatatctgacttctttttcatggacatttcaaaataaacctaactcatatggtacagtttttaagagggaaaagaaaaaaccatctgagaatctctggaattctgccgaaagtatcacttggcattttattctaccttctggatgcagttgattgacagtagtgttatgatgccaggggtatagtgactagaaaaagaaaaccagggaattcagtgttcttgctcatgaagaacagcttggttctttaaaaacaatgagattttgccaccccatctcacaaacctatgatttgtgagaacaatcccttttgtgttgcaagacttttacatttctcttcccacactatattagaagaataaacattgcttcataagtaccgattgatagtctcatttcatatttttaaaatagagttactttaaggttaaatttttcatgtagattaaaatgactaagtaaccattcacatatttcaaataaaatatatttttactacaaaaggaaaataactagattcttaagtgttatagtcaagtgtaattgagtaatatgaattctaaatgaatttctaagatctgctcagctttcactactttaggaaggaacaacttaagaaaaattttaataaagatatctcttcacacacatggcagtgttgtacttagagaacatgacccaaaattttttatgactgcatattgaattcctgatactcttgggaagctccaaaagcaccagtggagtttccagatgtaactgtggctgcagacccgccagtcccggtgttggaagggatcattataggctcttgtgtgcagactcatcttcagacccagaggaattaaataacttgcccaaagtcgcacaactttctcatggtaggttgggcactagaataaatattgctttttcttaagagttttagcctccgtattatgaaatcttctatgttctgctgatgatatctcctttcttcatctgttttctatttttaagcaatggaaatacaaacttgcaactccccatttccaacacaacttagaaaaaacaatatttaaagaaaaaattacaggcatctcatctcctttacctgacagatgcttgatagtaatggcctctagatagggatgacatctaatataaatgtgtcctttcaagtcaagctttctctgttcattagtagaaatattgtatatcaagtgtgcaaaaattttcttcaacagggagctttgtttccctccttttattataacaatctgagctttgtggtcccagggtctcctagtgcctgtctttaggtctgtttattcacatgaagaaagcatgtcatatagtattatctaagactcaggctgcttatgcatgatgacagaagggttcccaggcacaaacattcatccatgcattcatccatccacctattcatccattgatttggctgataattattgactactgttgagttgccctcagatttagtttctgtccttctgccatggggaaatatggggttaagccacaacatactcttctcttctttttctgcaccttcttagtatatttagttccattttgtctagccctgcctctgacttctttgttgtacttcaggttttttatcattgaaagttatttctggatcatagatcattctcttggtcactttgcttgttcacttataaaattaattcagaaaaaatgacccacagtaattaccgtaaatcacagaccataaactataatactgtatattgtattatagtacagaaatatttatactttaaaatgttttaaatatagatattataaaaagatatgtctcatataagtaatataaatacttttttattacctcttctctccctattctccaggccagtgttttaaaaatccatctttatatgtccatcctggaaaaaactcatgatcataaatgagtttctcaatagagtttataagcccacagttgaaacacaattgtcttagcatccatttagttgtcatacttttaagatttaatggcaaatattatgttttgtttcttcaaaagaaatattttaaaattttagtaaaggcagttagagaaggtagagataatggactgtttaatcctacttttcatcccacaagtgaacaaaaaaatgataaaacatttttcccaaaatgtagctttaactatacttaaatttggactaaaatgggagatatcttttctactattgaaaagccgtgtctgtagattaatgctaaaatcgggtgtaaaagcaaaatttgtttggcttgattgccaatggcccattcatttggctacagaaacaatagcacatagcaacagataatgatgtgagatcacctagctcaagtaagagtgtctgatccgtcaaaaatatatacatcaagattcaaaagaaatgtgtgttttctcaagtcatctctgtaaaaatacattaaatagaggaatagaagtttgactttgaaaatacattgcagacccaatccgtctttcctattttctggtgaaaagtatcaaatatgtggaacctggaactgctattctccttcttaaaaatctttcttaatattctattgataactggtgcaagcctaactttttgtcttacccgattcttctcacaccaaagtgataggaccttcaggtagcctttggatagaagataaataataatttaactattgatggaagttagtattagaattagacttggaagtctatggaataaaatgattctacaacaatttgtacttcagacattagtataacaaaacatgtttgcccgtgcatgcggaaacaaccaatttcatgtggatgcttatattcacaaaggagtaaccacctggggtttcccactgttgctccagagaaaactagcagcaggagaacttctctgaaggtatcaagacatctttaaaaaacacttgttaagtgttggttcagctaaagcagggagttttcagttagtaatggcttttaaaaattaaaacaagtttagcatgtaggtcattaaccttgaatcactgtcatgattattattaaccatctgttctcaaatcgaaagatatttttcttttctagatcacatttattctcacattgctcaatttcactatatatcaagacatgaaaactgtaaaaatcacaccttctacattattatttttattgaaaaattcctaatgaaacagtgcgctctgggatagagaaaggaactaactgacattttgcttcttaacttgtttttatgcaagttctaagtggtttctggccatgtacataaaagacaaatatctggaaaaaaaactagcagaagtcagttatttggctctatctactttgagaattatgttatataaatgttaggaaattttttgtaatattcttatttagaaatgaaatataaaaagttttaaaaatatctaaggacagtatacagtcctaaagtaaagctgttaggtaaatgctacacaatcctcttattacagagtcacttacctgagaatataagaagagggcctcttgtttaagagtaaatgtgagctgcaatcaggattctgcactcatttggacacttagttttgtttttccatgactggtgttgcctgttactgagacacctacctgtcatgtgaccacagcttatgttacaatgtgtctagtcagacttagagatgtgtgaaagagcagtacctagacgggaaactatgggtctataaaggttttgccttcttgggcggagttcaaactaggaagccacaaaacttccagttgcattttcacagattaatgaaatatattttacacttttcctgaaagatattttatttgtgcaaaccttgttacaaagtacagccagttgattaatcgatgaagtgatttgtagtggattcttatattttgtgtaagggtatatgtgaggccctatatatgaggctttctatataatgaagtataattcagttcagcatttcaattcagcaatcacttattgggcctctactcagttgccttcagggctttataatttaattgataaagggaggttaattaattaattataacaacagatcgcttaatagtgtaactactaatttaattaatgacaaataacaatacattaaaagaaatgcattaataaaaataatatattggtgttatagacaataattttctgattaactttattattattatttcaatagcttttggggagcaggtggtttttggttatatggagaagttgtttaggtatgatttctgagattttggtacactcataacctgagcagcatacactgcacccaatgtgtagtctttcattcctcaccttcctcccacccttcccctcaagtctccagagtccattatatcattcttatgcctttgcatcctttagtttaggtggcagttataaatgagaacatgtaatgtttggttttccactcctgagttacttcacttagaataatggtctccaactctatctacgtagctacaaatgccattattttgttcctttttatggctgagtagtattccatagcatccacacacacccccctatgctttatatatatatgtaaatatatcacattttctttatccactcattggttgatgggtatttaggctggttccatatttttgcaattgtgaattgtgcagctataaacatgcatgtgcaagtgtctttttcatataatgacttcttttcctctgggtagatacctaggagtgggatcgctggaacaaatgattgttctacttttagttctttaaggaatctccataacttttccatggtggttgtactagtttacattcctaccagcagtgtaaaaaaatgttccctttttaccacttccatgccaacgtttatttttttattttttaattatggcaattcttgcaggagtaaggtggtatcacattgtggttttgatttgcatttccctggtcattaaagatgttgagcattttttcatatgtttgttggctgtttgtctatcttcttttgagaattgtctattcatgtccttagcccactttttgataggattatttgttttttcttactgatttgtttgagttccttgtagattctggatattagtcctttgtcagatggatagtttgcagatatttctcccattctgtgggttgtctgtttactctgatgattatttcttttgctgtgcagaagctttatagttttaggtcccatctatttatcttttttgttgttgttgcatttgcttttggtttcttggtcatgaactctttgcttaagccagtgtctagaagagttttaccaatgttatcttctataatttttaaggttttgggtcttagatttaagtctttgatccatcttgagtggatttttgtataagttgagagatgaggatccagcttcattcttctacatgtggcttgccaattatcccaacaccatttgttgaataggatgtcctttccccaccttatgtttttgtttgctttgttgaagatcagttggctgtaagtatttagctttatttctggattttctattctgctccattgatctacatgtctatttttatagtagtaccatgctgttttcctaactatagtcttgtagtatagtttgaagttgggtaatctagtgcctccagatttgttattttttgcttagtcttgctttggctgtatgggctgttgttttgttccatgtgaattttaagattttttttcttgttctttgaagaatgatggtggcattttgatgggagtcgcattgaatttatagattgtttttggcagtgtgctcattttcacaatattgattctgccaatccatgaataagggatgtgttttcattagtttctgttgtctgtgatttctttcagcaatattttgtagttttcctgtagagatcttccacctctttggttaggtatattcctaagcattttttttttttgcagctgttgtaaaaaggctcaagttcttaatttgattctcagttttgttgctgttggtgtatagcactggtactgatttgtgtacattgattttgtatctggaaactttactgaattaacttatcagatctaggagctttttggatgagtctttaggttttctaggtatacaaacatatcatcggcaaagagcaacagtttgacttcctctttagcagtttggatgctctttatttctttctcttgtctgattgctctggctaggatttccagtactatgttgaatagaagtggtgaaagcaggcattcttgtcttattccagttctcgggggaaatgctttcaaattttcccccgttcaatataatgttggctgtgggtttgtcataagtggcttttattaccttaaggtgtgtatcttatatgccagttttgctgagggttttaatcataaagcaatactgaattttgtcaaatgctttttctgcatctattgagtttatcatatgatttttgtttttactcctgcttatatggtgtatcacatttattgacttgcatatgttaaagcaaccctgcatccccggtatgaaacccacctgatcatggtggattatctttttgatatgctgctggattcatttagctagtattttattgaggatttttacatctctgttcatcagggatattggtctgtagttttctttttttgttatgtccttttctggttttgatattagggtaatactggcttcatagaatgatttagggaggattccctctgtctctatcttttggaacagtttcaatagaatttgtaccaatttttctttgaatttctgatagcattcacctgtgaatccatctggtcctagactttttttgtttcctgacattttttctattattgtttcactctcactatgcattattggtctgttaataatttctatttcttcctgttttaatctaggaggtttgtatatatgcaggaatttgtccatctcttcttggttttctagtttgtgtacgtaaatgtgttcacagtagtcttgaataatcttttttatttctgtggtatcagttgtagtatctcccatttcatttctaattgagcttgtttagatcttttttcttgttttcttggttaatcttgccaatggtctattgattttgtttatcttttcaaagaagcaggtttttgtttcatttatcttttgtattgtattttgtgtttcaattttatttatttatttatttatttttatttttattttttgagatggagtctcactcttgttacccaggctggaatgcaacagtatgatcttggctcactgcaacatctgccttccaggttcaagtgattctcttgcctcagctgcccgagtagctgggactacaggtgcctgccaccacacctggctaatttttgtatttttagtagagacggggtttcaccatgttggccaggcaggtctcaaactcctgacttatggtgatccgcctgccttggcctcccaaagtgctgcgattacaggtgtgagccaccacactaagactcaattttatttatttctattctgatctttgttatttcttttcttctgctgggtttgggtttgctttgtcttgtttttccagttcctagaggtgtaagctcagattgtctatttgtgctctttcagactttttgatgtagatatttaatgctatgaactttgctcttaacatggcttttgctgtatcccagaggttgtgataggttttgtcattattattgttgaattcaaatatttttaaaattttcatctttcttgatttcattgttgacccaaagatcattcaggagcagattattcgatttccatgtatttgtatagttttgagggtttcttttggagttaatttttaattttattccactgtggtctgagagaatacttgatataattttgattttcttaaatttattgagacttgttcatatggtctgtcttggagaatattccatgtgttgatgaaaaggatgtagttgttgggtaggattttttgtaaatatctgttaagtccatttgttctagggtatagtttaagtccatgtttctttgttgactttctgtcttgatgacctgtctagtgctgtcagtggagtactgaagtcccccactattattgtgttgctgtctatctcatgtcttaggtctagtagtgattgctttataaatttgggagcccaagtgttagatgcatatacacttaagattgtaaatttttcctgttgaactaattattttatcattatataatgtctctctttgtcttttttaattgttgttgctttaaaatcttttttgtctgatataagaattgctattctttctcactttgagtttccatttgcatggaatatctttttccacccctttaccttaagtttatgtgagtccttacgtgttaggtgagtctcttgaagacagcagatacttggttgatggatttttatccattctgccattctgtatcttttaagtggagcatttaggccatttacattcaacattagtattgaggtatgaggtactgttctattcatcatgatagttgttgcctcaataccttcttgttgttgctgttgttaattgtgttattattttatgggtcctgttaaatttatgctttaaggaggttctattttgatgtattcaagttactgtttcaagatttagagctccttttagcatttctcagtgctggcttggtagtggcaaattcagcatttgtttgtctgaaaaagactttatctctctttcatttatgaagcttagtttcactggatacaaaattcttggctgataattattttgtttaagaggctaaatatagggcccaatctcttctggctagcagggtttatgctgagaaatctgctattaatctgctatgttttcttttataggatacctgatgcttttgcctcacagctcttaagattctttccttcatcttgactttagacaacctgatggctgtgtgcccaggtggtaatctttttgcattgaatttcccaggtgttctttgtgcttcttatatttggatatctagatctctagcaagactaggaagtttttcttgattattccctcaaataagtccttaatgaccccactatataacatgaaatatctgttattggtactgaggtgctggccacaaacaattctgtgtgtcctgaaaactcttcagaatattcgtcatctttagcacttgttatcttagtgtttgggcttggcttagagtgatacatctcataacagggcaacagaaagaaccaggaaccaagatttatataacataagtcagtaaaactagaggcaccagaggtttacatttacattaggttacattttctaacaggtagcaaagcacatgaatgaagttcagtggaaggccttcctcaggaatccagtaaaaaccaaacatacacacacacacacggacatccgtgaggcaggaagggatgtccactatagtacagacaagcatcctggaaggccatcaaggagtaggtgggtttcagttgcctcaggaatgtggcatggacccaaactaagtgagtacagatacttgtcattgaggagaagattcaaaatagcatcctaggtgtaaaaactgaggcacctggggcaggggaactaggtctctggaatgttggcttaaaagcacccctctcaggaaaggcctcatatgccatgcagggggttatatatgtgttgtgggacacagatggcaaggagataattctatgcaccaggctccactactaacaggtaaacagaccaacattaacagagacttaggtaaaaaggtaggtgcccagtggtcagttctcaggcacttccaagatgcacctaacagaaatgtaacttggtgtctattgtgtcctaggtctaacaactgaagagaagtgaattagtacctcttgtggacagagaaacaggggcagagacccattacaaagctgtctcagataggcatttgaagctgtttaagtatgtagaggcttaagtcaggctggttctgaaatgtgagagagggttaagcttcatgggaaatcagcagggtagtttgctattttttattataaccaatctcacaatagtttgggacatcaaatatcaaattgttgggaatatttatccatattagtctttttgccactaatatttaaaaatagtttacaatatacaacaaaaagttgtaaaatttccatctccacttaatcgatcttatgtaacccatacaatacatcaaatgtcctttccccactttatgtttttatttgctttgtcaaagatcacttggctgttagcatttgggtttatttctaggttctctattctgttttattggtctgtgtgcctatttttataccagtgccatgctgttttggtgactatggccttatagtatagtttgaaagcaggtaatgtgatgcctccagatttttctttttgcttaatcttgctttggctatgtgggctcttttttggttccatatgaattttaggattgttttttctagttctgtgaagaatgatggtggtattttgatgggaattgcatttaattgtagatttctcttggcagtattacccaggcttttcttattttggcaccctgtgctgctgtctccttttccttctttctgcttctcttaaccaactgttacctacacttcaatactttctgagggcaattcatcctccagtaagtctccctgaatcttctcttccttccctggcttattatatatccttcctcttggttcccatagcacctatgcacacttctgtcattgcacttgccaatttgttttataatgatctgctcatctgtctcctcacttagactatgagctcactgagagcaatggctgttgcattcaccttatatcctcaacaccattctgaaggcaagagaaagaatacccagaggtggagctgggaagctggttgtccaagtagtgaatgactctagtttgaattgaactctatagccagtgggcaatgtggatgtgttgacagttttttaacaggggactagtgaaaacacattttgggtttagaaaaaattgcaagtctgatgacatacataggagaagagattagagataggaatttcacttcagaaatttaaccacaagagcaagtgacagatcacggaagtctgaaccagactataaatgtgagaatagagaaaaaagttaacaatttgggtgtgaaagggcgagggagagaggtgtgaagaatgactaagtgtggatctgtttttaaggattgaatggaaatttgagcattttagctaatcaggcctaatattgagcaaagcaaaactcttgcaaattgttatttcaagtgtgggctgagaaaatgaaaaaatataaattctcacgttataacctcttccgtgtgtctgatttgatagaatccagccccattgcctccaaattccattgcatcttagaccagcaaacacaagtgaattctacttaaccccagaattctgtatgaaaatcttactgcctttttttttctaatcatgtgtcaaagtgtgggaagaacttttatttatgttttaataaattgtcagtataaccatttttacttgaaaatattataatttttcaagtaaacaaattgtttctctaagttgaaaattttatgatggaataaaagtatttttcctcaaaacacatagaaattttacaacaatattttagagttaactaaatgtttctttagtagtttagtcacttaaaaagtgatatgattatgaaaatacttaaactttgtcttttaactatttctaataatgctattggtataatttcatatttttatactgatcttttctccaaactttagtaaaacatacttctgtaaacccctgcccacaaaactgaagtccacatttacttctgaatgactgataagtttgtaaaagtatgcatgaatttcgttattaaattaaagtttttattatattttatgcacaatggtataaattattaaattaattttcaagcttatagaacattgataaagattgtcattagaaaaccctgagttgattgttatacattacataacctttcattggtggattagtgaatatgttatagggtgaccatgaatccaaagaatcaaagctggctacagcaaacagagggtcaaaaggatatggaactatgcatgatccagcaaaacactcaatatctgttttcctggaatgttaaaagacaaagaagaaaacttggggaacactagatgcatatagttctggttctttaagaataaaaatatgggccgggcccggtggctcatgcctgtaatcccagcactttgtgggaggccaaggcgggtggatcacaaggttaggagttcaagaccagccaggccaacatagtgaaaccctgtctctactaaaaatacaaaaaaaaattacaaaaaaaatacaaaaaaaaaaatagccaggtgtggtgacaggcacctgtattcccagctacttgggaggctgaggcaggagaatcacttgaacccgggaggcagaggttgcagtgagccaagatagtgccactgtgctccagcctgggtgacatagtgagactctgtctcaaaaaaaaaaaaaagaataaaaacaagaatggtcagagtcctagtaccttgtccagtgtagtgctgccttgagattgcattgcaatctgtctgagagatagtaaaagaaagtgataccttccttagccctgtttctctttagactatgctttcccctctccaagttaatatctctcagtctaaagcctgggaaaaggtgccaattttgtttttctttcttcctcacacctcctagaagttacactgggacactattacttttttccaggctttggccatgtgtattgttttggagagtcaacttccttttttctttcattctgcaaatagttttgagctgtcactctgtactaggtgctataaaacttacaggtgcattttacatgcctatttcctataggccacgatttaacaaaatgttcataaatgagaattaggagtgcatgtattgaatcaccacacattaactgaacagctttcattggccagagactatattgacagtggagattcaaagataaactagagaaatctcatgcttaaataactttctataataaattatataagagaagtaggttcagggatcttgggagctcagaagcaggatgagttaaacaaaagttggattttgcctttagcttggtttcattatcctgaaggaagagcctgaaatatagtgtagggtgcaagtagtatatgtgggtggcaatctcgggaaacaggagcatgtgatgaataaggagaaaaagccaatataaaggtactgcattgagggcaatgagggctctaattctctgcaccttctcaagcattgtgcagattggttttctggattatcagcctgaaggacaaaacgaagaaacagccattagctcctgtctcccattgtctgagagctgccactaggatattaacttcctgaaattctgcagaaatctcctcttactttggcactggagatgcccatacgcagaaagcaaaaaggcacagcatatttaaggaagctcataagaaacagtgcatccagaagtggcgagaattggaggaatggacatgagactctaagaaccagcgcctttgatgttccttttgatctgttatgtagctcttcttgtacacaggtgagcaaaggcatgctggacaaatggattcacatgtgctaaagcatggggcaaaaaccacatattaattcaggaaaagacaagatgcgtggccctctctgtctctgtctaagggtgaattaaagaggggatatatgtacagagtggcagggcaggacttgagataagaaggctaggtgggtgctctcatgctagtagcattatagtacaggtgatgagaagctcctgaagaatcatcttaacatttgtattttagagcaacagtattgagttctgacttagagacagcaaaactaaagacagaaagactattttgattattaatgatgtagatataagaatatcgtcaatgtgaactaaagcatgaagctacttatgatatatcattaaaaggatttaactgattggagacaaacgagagggatggggaaaagaattcatttgtttttagttgctctttttttcctacttattcctttgttccgagtgtgaataaactttgtaaacttttatactaaaacattctgctcattcatacttatttctttgatgaaacaaggaaacccttgtatagttataaacgtgtgaatcaatttaaatattaggaaatttttttaaataaagctagttttctgaaggggaaaaacttggttcaattttttgctggcaatctgctttgtgatttttgaacatgatatctacatctagactcatgttttgctagctggaattttttttcaaattaacgctaccattattatatgctttactatttagcttttgcagccttggaaatctatgattaatacaaataattctctatggcaattttaaaaatacatgtaaaagccttcaatctacattgctactgtgtcgtagcacaaaaaaagaaaatgtgatcaaattttaataaaatctacaatttattcccttctaaatacagtcctagctcaggagaaaggaagctatttgtatttttcagaatcaaatttccctaaatgaatatagagaaagaattataactgaaatattgttgaaacagtggtcatctcaaatctgaaggtcattccaaaaaagtttctgagttttcattgcctcaatctaaaagttggcctttttggtaatagatgaaagtaaaataattgaaagggtctgttgcagttttggaatatcttgaaaatatagtagagtgaagccttcttcccttaaataaaagacaagttgctgattgttttctttctagccagataagaataatgccttctttctcttgttagtcttaacacctcacttgttactatgtgtcagaaaggcgagacaccataaatggagatactactgatggaggtcatctgacatggggctggtaggcagtgggaagactggtatggacacaggtggcttaggggttggggaatgatatggaactaaggaaatgataattagcagaacccagtgtgcatgtgtgtgcattcgtgtgtccgtgtatgtgtgtactgtagcacaatgcaagaaagaaaaaacaaggcagacttttcataatttcagggataaataaatcctttatcacttcatgtagaatattggctacttggaggtatatctaaacgtaaatatataactatataactacatgctaattaaaaacatacaaagaagaagtgcctaaagaattacaacagaaagtggcatagtgattattagagttaatataatataaataaggccaggcatggtggctcatgcctataatcccagcacttttggaggtcaagttgcagggatcacttgaggacaggggatagagacaagcctagccaacatggtgaaacccatctctactaaaaatacagaaattagctgggtgtggtgatgggcgctggtaatcccagctactcaagaaactgaagcaggagaattgcttgaacccggaagctggggctgcagtgagccaagatcgcgcactgcactccagactgggtgacagagaaagacccggtctcaaaaaattaaaaaatagtataaataatatttcaaaacacaagtctgttaagataaaaggtacagaggaatggtgagatgacttttttatttgtgtgataagggactgttttctgtgattgtgagaaagaccaggagttaagaaaaagtggccatcaataaatcagccacttatggggaagaaccataaaccactctcagatgaaatacaaatgcagtcattatttaatattattggaatatttgtattagtttttggtatgtgctgctagtgctggtacattttagtagtcaattaatattttgttaatcttaatttctaactaaattccagagtgaaatggaaataataatgaaaaaattttatttacaaaacagattttgtttttttctgttaagaatgatacacagttgtccttcagtagccataggggattggtttcaggacctcccttgggtactaaaatctgcagatgcctaagcccctgttataaaatggcttagtatttgtatataacctatgcacatcctctcatatactttcaatcaggggtccccaaccccagggccatgaccagtactggtccatagcctgttaggctgttcgataccaggctgcacagcaagagctgagctcctcctcctgtcagctcagtggtggcattagattgccataggagcacgaaccctattgtgaactgcacatgtgagggatctaggttgtgcgctccttatgagaatctaatgataaatgtaatgtgcttgaatcatcccaaaaccattccccttcccctcaccatccctgtccgtggaaacatttcttccagaaaaccagtccctggtgccagaaaggttggggactgctgctttaaataatctctagattactgataatgcccaatacaatgtaaattctatgtaaatagtttttatactatattgtttagagaataatgaaaagaaaaagtctacatgttcagtttaagtgttgataagtgtgtagagaaaagggaacccttgtacattgttggtggaaatatagattggtgcagtcattatggacaatagtacggaggttcctaaagaaattaaaattagaattacctaagacccagcaatccctcctctggatgtacccaaaggaaataaaatcatcacctcataaagatatctgcactgctatattcattgcagcattatttacagtagccaagatatggaaaccacctaggtatgtgttggtgcatgaatggataaaagaaactgtggtatatgtatatacaatggaatattattcagccttaaaaaaggagaagaccctgtcatttgccacaacatgcatggacctggaggatattaagctgtgggaaataagtccaacacacatccacacacaaaattgcataatctcacttatatgtggaatctaaaaagaaaaagttcaaatataaagttagaataaaacagtggttaccggccggatgtggtagctcacgcctgtaatcctagccctttgggaagccgaggtgggtgaatcacctgaggtcaggagttcaagaccagcctgaccaacatggtgaaatcctgtttctactaaaagtacaaaaattagccgggcatagtggcaggtgcctgtaatcccagctactcaggcagttgagaaaggagaatcacttgaactcaggaggcataggttgcagtgagccgagatggcgccacttcactccagcctgggcaaaagagcaaaactctgtctcaaaataaaaaaacaaaaaacacagtccacacactggttaccatgagtgaggtggcagggaggagattgggagatgtagatctaaggatacaaagtagcagatatgtaggaggaactaaaaagctgacatgcaggatgacaactatagttagtaatagtgtattgtattcaggatttttgctaattgagtagattatagctgctcttgccacaggggaaaaagtgggtaactacgtgagatagacaatggatgtgttaatttttgtcactataataaccttttcaccatatacattcatcttataacagcatgttgtttactgtaaatatatacaataaaatttatttttaaatatctgagtatgatttgatgatttgtgaaaatagagtgaattataataattttaaatgtaagttaatgttattagaaaagaaacagaaagaacataccacacagaaagtctgtctgaaggatctttgttttctccaccaatacaagtgttcattgattcagaggtggattatgagatatgaccataaaacaaaaatttcaagggaaatatattttattcaatgaaaaattctcaacacaactgttatatgccagtaaacactatatcttttaaataacaggtcatatctattatatttaaaattcaaggagagactacattagagatgctattagatcaacttctaatttcaaagatttctaagatatggaacagttactccttatacaaattaaaaaagcaaatgctgaagaaattcagctacatggatacaccatgaggtggaaagatgctccataactcttagttaaactgcactaattacacataaaaggaaaatgtttcatttcactgtaatttggaaaccaaagaaagaaaagactgaatttttacatactgttaaagagattgcgtatctgttctaagtttaagacagaggcaaaatgtattttattcatttgtcctgcaccgtttagaaataaaattcaacttccttttaattttttttaagaataaaaaactcagtctaaggaaagtcttaaagttttcattttaagtgatccactgttctagaagtttaatattttgtttaaaatgtttatgttctgtattccaccaagtctagttttaaaacaaaacaaacaacaacaaaatacttctctaacttggagtttaaggtgaaagaaaccaattacgtggtttggaaatgtcacacttttcatctcttttttaaaaaaatttttaattcaggacagaaattgtatggatttagtgtaagtcttgggatctcacaagtgtcagtatttcactctcctccatatcttgatagcaataacttgaaataggatctcagtagctcaagcaatactgggctctgagagttggttaaaaattatttggctgagcgcctgttgctgagggaagaactaatctcgagcatatttttggagccaaataccaaattgtttgtgcttagcaacacagcaccaggcttgcccttcagaatgattctagaccaaatgccagaaatgctctggttctgactacagagttctattcacaaatgacaggaggcaagaggtcctcctcactttcagaagaaaggtcctttgctttcttagtcaatggtaggaaaaccattgtggttttcattgcattacataatttttaaggtgattacttcaataagaagtgctctgtgtatatgtgtgtttatagacgcattttttaaacactggagaatttctgaaagtagtacaaaccttgtaatgtcaagtagatgtgggaaaaagggagtttacaacattctctcctgacattgctctcctttggcatctgcatttttaaaatgttaaaaatgtttaaaaacgtgtgcttaacacttaatttggtgatagttgctgttaccaaggcaactctgtaactccacccagataaaaataaatcttgaagatgagtttctgtgtctctgagcaaatatttttgtgaatagtagaagcagagaaagttaaagatacctgagcttttgatctttactagttttatagatatgtttatagttatacatttttattcatacattttagataaataactttgtaaagcaattgattcttcttgtaaaaatcaagtatattcttaatagactgataaactttctttttttgagacagagtcttgctctattgcccaggctggaatacagtgccatgatcttggctcactgcaacctacctctgcctcctgggttcaagcaattctcctgcctcagcctcttgagtagctgagattacaggtgcatggtaccacaccccactaatttttgtattcttagtagagatggggttttgccattttggccaggctctgagaaactttttaaggtctcttttgcagccagctatttgtctaccttatttcattcttaatctcactagccaatattttttctgtttaagtgctttcagcaaatattaaatgcttgtgccttcagtcttatcctgtggaaacactggtaatgacaaaaacacatatttcaacctaatatacaatagaaacagaatgccagttattcatggaggagaagaatagacttctgtatttaaaataacattttgctctgtgttttaaaatcattcttccttcatcaattgtaagcatcttgactataatttatacacctaaagataaataattcagtagcaatgataactgaaaacaggacacatacaatgaactagctaaattaccatacattctcatccatttcaaaaatagctctgtacttttttcagattttgttagaagaatattcaatacaaatttttattcaatgaacacttcagatgtcaagattgttacccacatggacaacagtaacctaggtaaagattctgcagccaggcgtggtggctcacacctgtaatcccagcactttgggaggctgaggcgggcagatcatgaggtcaggagatcgagactatcctggctaacatggtgaaaccccatctctactaaaaatacaaaaaattagccaggtgtggtgtcatgtgcttgtagtcccagctgctcgggaggctaaggcaggagaatcgcttgaacccgggaggtggaggttgcggtgagccgagattgcaccactgcactccagcctgggtgacagagcgagactctgtctcaaaaaaaaaaaaaaaaaattttatacctgggctctgtgctcaccagcagaaggggtaacatggcttcttaggacaaccttacttgaccatttacttctttgacactaggggtattcttagatcagcaggtccttccctccacttatgcacatgaggctcacagagagtctgggaggcagggaatttatgattggaaacagtatactttttatctaagaaattattaatgtcactgcattcaagtgattaacaccatcaatatcttcaagactaaggggattacatgatgtgtaaaattagaaaactgtcatctactagtggctaggcactttaattatattaagcatgcaacaagagaactcttcaaatgaatccatctctcctctgtattatttccaacccttggatccccatctgtttctgcagacaacagctatgctgctgaatgtcttaatggtttgctgccccaactagcttcaagatactgcaggtcaagcatagcatcttactcttccctgcatctccagcacctctcagaatgttggtcacatagaagatgtttgctgaggagttgaataagaatatgtacaagggacacaattagcattgtttaaaaaagatgtaacaagatagggtaaaggaaagctttggaggataaatctttagaacaatcaataatatcttctcctctgttggttagttgcccttcaatctcagccactgaatcaaatacaacataattactattctgatatgttcttgaatcgaatatccaataataagatattcggatgcatagccatgtctaatatcaaagcccatgcttttcgctattattgtactccatacattagcttccaaatttatttgcaatccaaatattaaaagcaagtcataagcttagtatcgccaatgtgatactaagtatccacttactaaactttattttcaaaatgtggttttatctcagtttaatgaacacggcatgttttaatttacactttcatattatatagtaagggcgtggttacagatatgttaatttcctgtgctgcttcacaatgatggaacataatagcaaatgaaactgttaatttgcagatacccataggcctttggtgtctgaatagaaataaacacacctacaactgagagaggaagcatgtgaagcattccagtgaacagaggccatttattcagtcacagacacaggagaaaaacaacaattaaaaaaaaatctctgatgaaaagttcataaaaagttcactcagtttaagcatatgtcctataactacttaaaatagagttcttcttaaatatcattctttgctgtttttagatttcttctgcctgtatcaaattaatagaacacagcatacttttaatttgctctggtttcttagtggggcatttattaaacacattaaaacaatagtctcagggttttactgctgatgttaaagttctgctttcctacttaccaactgtgtcatcttaaggcacatactttgcctctctctcaaatctcccaaatggagaatgataagaatacgtacctcaattaaagaagctataacaagtagaatgtttggaaaagtgccgggtacaccataagcccactatgagtattggattgtattacctctgaaagctgcagaatggaattctcaaagttatatgtccctaaaatcctcttaagtgacagaaatggagaaattagcagtctgtctaagagagcttttctagagtctgggcatatgtttttaggacaagacagttcagcttcagcttaaaatgagagagcacgtctgtgtccttactcctgggtgccaggtttcttgtccccatcttaagacaaataattttggtggagaagaggcagtctctttgatttcgctctaaaaaccttttctggaggaggtagacactctccacccccgttttgagactcatgcagctgaggatgactggctgagtacaagcaattgttccttctaagcagtttcaattcttataacttgtggagatattcttaagtccaggggattttgtgtatggtggatttttattacaaagtcctgtacttcataggaacaaaataattcaaagtcaggaaccagatcaaagccacaactcagatatggcaccttgagaagttcatttgtatttcacttgcataaaaaccctcaccactgctatctgattttcacaaatcattcaacagctatccatgaagcacccactgtgtgtctggtctctgtgtcagtccctggcttcatgtgtctttccttctgtaccctgactccccaactcatgaacacatgaagtaaaaaaatgaaaatctttttctgacctctcttcaaaatcacttttttcaaaacaaacacctctcacctgctcatcctccagccagtaaatcacaggggcctagaaatgtcacttacaaatattttctgattctgtccctcccttcaagcttgccaacattatcacagtttagggcctgctcatctttcccccaatctccaattagatctctccacaatgcaattctgcacattccctgttacaacccttcaattatttcccagcccatccaaaataaaatctaagcctcttactaacacattcaggaactctgtggcctacggttttctacagactaattttccagcagttgacttccagtgcaagtgaaaacctagtgtcatgcctgcatgatagataaatttgaagctgaagagcccaaatgtatagaccatgccatgaaaggtttatagtcatgacacagtggccctatagtacagtgcttgaagctggctctctactgtcagacagaccacttgccagccatgagacctggggcaaaatgccttaatttttatgtgcctcaagttctcatgtgagatgagaataaaaattacccctatttcataagatttgataaagtgtttagcataatacctcataacaattgcaattcagtggtggttattattataaagaaaagatgattaactttatcttaatgtttaacttgttctgatagttattgatctatagctttgatatggaggtttgagaatgacctggaaagaattggccacaatgattgaagatagtgatacaagaataaaagatgactgcaaaatgtaaacctgcaataacagaaagaatgaagtcactggtctcatgggaactgatatgggagaaaaaaacagatcaaaaggctattcatgttttgggcctctttgtcaaaatggaaatgagaaactggggaataaaaattaaagcaattctagcatctggttttaacataattcttatccctaaaaagaatctataagaaactcccaaaatgacaggcagccgtgggtagcattgcatttcaagtaatcttttaattgttaaaatttaagtttccaacatgaacataaaattttcaacctaaaagaaatgagttccaaatctgagacaagtgaaaaaggataaagcctactagggggtaaattccatctctttagagatctagtacccaatttagcaatgtccaatcaagcctttaactactacatttgaacacctcatcatttcaaaatgttacttaatgatgccaattaactgtacaatgtctctgcatagcacatagccctaaaatgatttgtgcaatgttactgtcagtaaaactgaactacagggaatgctcatattctatgtcattatatacagaaatgcaatatcaataaagtgatatctgttggtattagaaaaaagtgaaaattttcatatctttctattttcttttttcctcaatgggatgctcttgttaaagatagctctgcatagtaaggtttgtataaacattatttagctaaagttaaaaggggtaacatactggttctagcacagatattaaaacaaattagtttgtaggtagggcagcaatcaattatattactaaccatagctttggtccttttatcctttcccatttgattttacacagtgggatgttaaaggttgaatgtctttggtatctataaacttaattgaaagctgttatttgtttgtttaagtctgttgatttttataatcataattttactcctatagatttcttgtaggagtactatatgaatttatgttgcactgaattttgttatgttatacaaattaataggcttttatttatggaaagctactattgatctgtcatttcttaaaaaattactaaaaagtgttaaaactttaaatgttggagagtttatattttaaaagttacatgctagaaaaacatgatgtctgagtatattagaagttatagataattcatctgtcaactataaaactctccaacactgcctttctttaatgaataatatgaaatttagcagtgaaaatgtgacaatgtacaatcctaaataaatcaacaaatttagagatgtacctctaaaaccattgtaaattcaacagtgtaattttccattggactttcacttattcattcattaaacaaatgtttgtgagtgcctgcaatgtatgagacattgtactgaagctaggcagtgtgagttatcatatgggattatcctttaaatacttctgagggcaaaaaaaaaaaaaaaaagaagagaaaaggtgtgaggaaagataaagggttaattcattaaaaaataacacttgaggactgttttctttgcaaggcataaagttatcaccctttcaaacagtagatatttcacatttaggatgcgagactccagttccaacaaagctcattgcacagctgctaccctgattaaactgctacatgaactctgagcaatgtagcatggtagccgcatgcttctgcttgcatgatggttaattccttccattctcattagtgattttctgagctttgaaattctgatggtacctaggatataaagcatatttatctaactgaaaaacagataattagatgtaacataaaatatgaatggctttgtcactttattgtagcagagaatgaatgtgggataaattaaagctgatgctagaacatatgcctattttttagctggaaaatttcaagatttatgtactttgggcttgagaaagaaatggagtttattttttatgcactgacatctctttttttttttttttggaagagctctcttaggaatgaatggtatgtaaatacagtaggaatgtaattatagattttcctgacccagttcctaaataatagatatcatttcagaagtgccccaatacctgaccttttgctccaagccatatcaaagcacacatctagtctacttttcactctcattcctagccactatgacaatactattcagataaaacttctagtcctctacttatgtgactcataccaacttgaccttacgatagtgactgggggtgcatatctaggttcatgctgtttgtccattattatggttttgtgagaaaaggcaaaatttctaggtaaagtgttatgaggacgaataatccaccaggcaaccaactgaccctttcatttgccatcttgtcacttcaaacagctctccagaacctgcagccagcacagaccaaagtcaggtttgtctcctcttctgttgatgaacaaaggttgattccatatcgtggctattgtgaatagtggcagtaaacatggcagtattgtatgaaaatatcacagatagcccttaaatatgtgcaactatgatgatctatcaaaattaaaaattaaaatttatttttaaaagttcagttagaaagcttgtagttcctggcaaactactacctttctcggcaaaagaatttgatatctcttaaatattttctgcctaatgctgatagattgtatttacatattccattaatgcaataaataaaattacaccaaaacatcagcattatttatttccaggggcatctctcaaaataaattcctccaaaattcacaaaaccaaaaccaatgtgaaattgtactcagggatgcaaatgtagcccagtgaagcatttgcccacttgtttggtattattgaagcacaattagaaaaatgtgcaatgtatgcccaaaaattctataataagggccaggcgcggtggctcacacctgtaatctcagcattttgggaggccaaggtgggcaaatcatgaggtcaggagatcgagaccatcctagctaacaccatgaaacccagtctttactaaaaatacaaaaaattggcccagacgtggtggcgggatcctgtagtcccagctactcgggaggctgaggcaggagaatggcatgaacccaggaggcagagtttgcactgagcctactctccagcctgaacgacagagcgagaccccatctcaaaaaaaaaaaccataataagaactttttaatatactatattataatgtaaaaagactagatgtcaaacaaattaggtgatgggaaggaattgagggagaattttagactaagcaattgagcagcacctgtttttcaccacaaatctgttacatgtattgctcaattgtgctgaatccatattgggtcctggtggctatgtaatagtctctttcttggataaatgtttgtcctctcttatggtttactaatggtgtacagaacagcattgaatagtggttatttcctatgacttcctagatatctctctcataatcctgaatgttttaaagatcattcttagatagagtacagctagacacgaaccatagtggaaatcaggtagacaaaatttaaaaggagtcttaattgaaggtcattttattgtcctcagtattaatcttacttaaaacaaacctgtcactgagcagaactcaaaacaccagagccctttgccaaatgtgattttttacaacaggagcgctggcagttgagaggagtattctgtcacacttgagagaattcgagtccctgaagatttatatgaatgcttagctattatcgaaccatctcttcacagatgacttagtaaatgtctgcctttgcatcagataatggcttacaagttaatctcctcttgctccctgttacacacatatacaccttcttcctaaacagctcataaggtgaaagaaagactcagatttctgactatgtaattgataatatcacacggactgcctgctcatcatctgctagtcacattggcagagttgacagttttggagacactgaagacagtgcatatattaggaaataagcagtttcctgatataaattttcttgtagtttataaattacatagcatttattattccctcatattttataacatttaataatagaactgacacatatattcattttaaactcaattgtgtataataactatcatagcaacccttcagtgcctaaatatcaaatcttccattcctcccatgaacatcttgaatatataggtactgtggttagctccaacaagcttttggttagaattcattgcactgatacatagacattgttttaaaggcaatttcaaatcaaagctgtcagctgtgaatcaagcacaccttaaaaagtgacacatttgtcactagattccagcctctcaaattactgacacgcatcctttttatgtaaagatgacattgttctttcctgatatattgcattcctcatgaatttcttatagtcatagaatttttataaaccatttcagaatcgctgaaataaacatcaatatttttaactttttcattctgtcaaaaatattgtatgcagagatattgctgtaagtgtgtatacctgtgcttaagagactagggctgaagagaagtaatcaaccgaaccactggtgtaaatgtgcgtcacatttttagtgactagaaattgaaataattccaacaaatttatgtgctttgggcttgagaattcagactgccttaggctaagataaaaatcttttcctggtactatataccttcttttattgaatgactacctggctctttctattatatatgcagattttgtacctctggtcatctttgtaaatggtgcctaaaagatatttgaagaataagtgaccagcaataagaacaaatgtctatacaaaagcaccctttagttggatgtaattcactactttgagttgttaataacctctaaggatgacagtagctattagttgaataaaccattatgtctattattagaacactagatagtttataagtccaaacaatgcataaaatacctatctcatgttaccattgtttaggttaccagataattgttctgtccaattattccacttaattttttgcttgcccattagctaaatggcaagataaaatttgtcaaacgggggggaatgtattgaaaatgctagacaactacacttaaaatgaaaacaggccaggcgcggtggctcaggcctgtaatcccagcactttgggaggccaaggcgggtggatcacctgaggtcgggagttcaagaccagcttgaccaacatggagaaactccatctctactaaaaatacaaaattagccgggcatggtggcacatacctgtaatcccaactactggggaggctgaggcagaagaatcgtttgaacccaggaggcggtggttgcagtgagccgagattgtgccactgtattctagcctaggcaacatgagcgaaactccatctcaaaaaaaaaaaaaaaaagaaagaaaagaaaacaaatgcataatttgcaaatattatttttatattgtatgttatctagggcttctaaatgcattcttcttataagcctaggtttgcaataacattcatttagaattgagtaattttaaatataatattttataaaataaaatataataatttctcttaattctttgaaaatattaaattaaaagggggttgcaaactctgcattccacatttccatcccaacatttaattttagcaattttgtagtctgcctaaaatgcaatccatcatttactgtttagaaaatagggaatgtacacaaaggcctttcagctttccctgaactccataaaaatctttttgcttctttactgcccccctttgtcaggagttctgaggaactgttttttatcttaagtctcacaaagcatttaggagaatatttaaacttaaattcttttaaaacttatgttcaggacaaagtaacattgtatgcattggtgtcatatgtatttaaattttgaaatttttaatactggcaaaatgaggtttcaattttaatataaattatttaacaatcttaaatcattaaatatattacttaatatatttaatatatctaaacagtcacaattttcccatactaataatcataaaaaatcttacccaatggtcatatagatatacttaatggagttttgggggggtatttttgtatattaaaaaattcatatatttgccttacttagaagaactgattaaatgaaagtataatattaacaaacatattgttattttatatttgcatttgtgataattatatttgaaacgttcaagattttccaatgaatttcttttgcatttgcgtatttgtgcctttttattataaaaataggtggctttttagttccactgcataagtttcaacataggtctacaaatagtgcatctttttgaagttaatcattataatcacaaattgaagttgcctgagctccaattggagtctaaatggatgactgaatcttattattcgaaacccactgttgctacacaatatggccacacaagagagtacacaagacccgtctgattcagcctcagtgccataaatattttaatggtttcgttggaatctggaaatggagctcaccacaggagatgcttcttcctttgactctcattattatttcctttacaaattaattaataaaaacttagatgctaaattagcacttgatgaaaacttatatagccttgacattttgattctgtgagtgaataaaaatacttggagaaataaaaatcctaatcatgttcaggaatacccacaaggtaacaagtacatttttaaactttaaaaacatttattattcatgataaaacatgttgtgtgatttaaatataaatttttattatttgctttaacttatttccggattaaaaagtaaatgtttacctagctgttctaaatggtaatcctcatgattaaaacagcaatttgtcatatttcagttacaaatgatcttttattattagttatagaacataagtttcttcattgactgaggcgatgtttcaagtagataaatctgttaaaaaaattgtggtcatattctgttaaattctcataccaggcaatttgtttgatattcaggaaaaacctagccactgaccaaaaactctacctgccttctcagttgtatcctcttggacttaaaggggactgggaaagttataagatggttcatgatagtccatcaacatcccaagaacaaaaacagatgttgtactgacagcatcatatgatcatatgcatgtaagagcacattcatattgccaaatcagttggaatttttcacggttgaaagttaaatgaaatgcttagatgtatgagtcatcggagttaaagacaattacagccagatttatggctgtgctaaaataaagctagttagaaaacagaccaaattccatgacgataccaagtctgactaatgattcaccttaaatttcggagcaacatttatcctcacttgtttgtttatttgacaatgtgcccttatccattaagtaactaggaggaagggaaaagcactacgtgggtgagtgacaagacactgacactgatttgtgactttggataattcctggatgctgttatctgttttggcatagagatggatctgtaactgctaataattgccgactgtgaccatcccagaggccatttacttaacccaggtatttcagacctgacagcccgaggataaacacgatttccctccatcactaacttcatctgcagggcctaagcctccttcacagtctctccagtgatttattggcatctccaagggtatctcacatgtgctgaagaacaaatctgctcactttcatctgcttggttttcccttttgaaatctgctgctttaaaattactaagggaggaatcatgcctgctgctacccttgccagtgaccttgcagtttgtgccctgattgttccaattaccacaatcaaaacagaagcgtttgcagttactgcagtgctctctctgtggatgtcaggtctgactcagagagccaggctggggaacagccatttccactcttgtacctctgcaaaaggacttccatgttccgtaaacagactcccacctctcattttccccccaagcaaagcatcataaattagagagcatgtaacgggaaagaaaatccattagccatttgggttcagtcagacaagccagctcatggaaagtttatacaggaaggtcacatttcaattgagatcaggagggtgaaagggtccagctgtgtgatgagagagagaatgttcgggaatgtggaacagaggtatccaaggcagaacaaactcgtatatgaaggctttaagggtgtgcaaatctagcatattttatgacataaaagagtcctgattagctagaatatgatgaatgtgagaagaggtgaaggctggagataggaaaaattattccagatcttataagctatagtaagaaatttgcatattatatatagacttgtgggaagccattggattttgtaagaaggagattaacattatcttatttatgttatttgtgatttataaccccaaatgtgccagatacaaacaaaccaaaaataataataataataataagaagaagaacaacaacagcaatggaactgtggtgatggttttggtcacaaaatgcatatatatctatttttcacaatgcaaaaatatttcattatttcaaattttaacataaatgtgggtatgcatgagcttacaaatcttgaagtttattggggaatattggtgagcatggtttttattgcatggtcacaacttactaatgggaaacatctgaatacctattgagttaatgcatgcacatttttattttcctggaatactgagaaaaaggttgctacataatgtcttgatagcttctaagtcatggctcaaaagtgaatgtggaatctgctaatcggaatggactcagattcagccaagttctcaaaaacatttgctttcatagatgtcttcaagaaacaaggagtcttgaatttaaattgtgaagtgtctatcttagaatagagagatttaaaatctgactgtattttgtttaaaaaagcctatataactgtattatataaaattatttatactacagttaaaaaaagaatcccatcctatttgtgcctaaataagtgcctgcttgtagcatgaaaactatttgttgagggtccttagatcctcagagcatgctgtgaaagtaggtacaattgttctttctatataagcctcttaagataacagataattgccagaaatacagcacacagtacaaaattaccttgttttacttttgccacaaaaaacaatttcttttggctttgagcaataaagtccaatgatttttttcctttcaaaatatcttcctccctctccataagttttatatttattcacgaaggaatattccaatatcggatgtttttgtctgtgtctcttcctggaacaaatgttaattaatctctttgggtttgtatgtcaagtggaggggtggggattggggacaggtgatagttgtctagggagttaacttcatctctataggagagtggatagacgctgtatacgaaaagctcttgaaaagggaaatacagcagccacttcctcagggcttccatggtggtcagactccttgattgctttagattaactctggcttttgtccttcggaggccaccagattgggtggatagacattgtccttgctgttcttttgacctacctacttgtactttaggggaaaaaaatgcctgtaataggttaaatgctttctcaaagatcaccaaagtatataacacatggcaaatagacagagaaatgagacagtataatcagtataatttataaaagtaccttacagcaggatcccatgggatatgggttttttttaaaaaaaatctacctaatcttttcattgaactcctattcaggattcattatattgaatatggctcagagacctggaaaattgtttccacctttttaatttattcaccatcatttatggaagttttcaaggacgtttacttacctacctcagttaacagattgtactacttgggaagtctataaatatgagcttaaagcattttctgagttttaaaataatttagattgtgtagaatgttaaaactaaaagaggaaaaaattattcagttcctcagttgaacctagcaatttatcttttcacagtgtgctcaagtatagtttttgaaaagtaaagaagatggtttttatacaaacataaacacatttcaaagattttattcaactaattaattagtagtggagccaataagctggtaagactggtttaaaggaatatctgaggaataaagatttatagaaacagtcaaagaaattctaaagagaattgactaatagatataaatctagtaaatatttgattaataatagcagtaacctatggaattatgttttctactgagcataaatgagcatgaatctctttgggtttgtatgtcaagtggaagggtggggattggggacaagtgatagttgtcaagggagttaacttcatctctataggagagtggatagatgctgtataagaaaagctcttgaaaagggaaataaagcagccactgcacatctgcacatataacctgtagatctgggggctctaataaaaaagttaatggcaatgtcaaaatctggtgttttatcttagataacttcatagtcattgattgagccccttaaaaataacatttaaaggacatgtagtcattctgtttctttattgccaagttttcagcaatttttctcatgagaatgagtgctaagaaacttttggtggagcgtggtggctcaagcctgcagtcttgcactttgggacgccaaggctggccaattacttgagatcagtagtttgagaccaccctggccaacatggtgaaaccttgtctctactaaaaatacaaaaaaaaaaaaaagtgggatgtggtggcatgcgcctgtaatcctggctactctggaggctgaggcacgagagtcacttgaacccgggaggcagaggttgcagtgagccgagatcctgccactgcactccagcctgggctacagagggagactccatctcaaacaaacaaacaaacaaaaaagaaacttttaaaatataacaatagagacattacataggcccacaaaaccacctccaaaaaagcattctatcacctgcaagaaagcatatatatatatctgcttttgtgtatatatatatatatatatatatctgcttttgtgtatatatatatacacacacacacacacatatgtgtgatatcagcatgtgtatttacacatatattttgtgcatgtatatttttaactaaaaatgtgctaggagttagatatgaactgattttggaggaggtgatatgctgtagagagagagaatgggagaatagcagtattataatctctctccattgtattcagtttttttctttgtctgaatttttaatagaagtcagccagaagatgttagtttctgggaaatgtgttgagatttacagtcaaatccagagagaactagaggcttatgagtaaataagtaaaggttatgcagagaaagtattctttttcctgtgtaaacttgaatattggccaggcgcggtggacacctgtaatccagcactttgggaggccaaggcgggtggatcgactgaggtcaggagttcatgaccagcctgtccaacatggtgaaacccattctctaccaaaaatacaaaaattagtgggtgtggtggcaggatcctgtaatcccagctactacggaggctgaggcaggagaattgctttaacctaggaggcggaggttgcagtgagctgagacagcgccattgcactatagctacggcgataagagtgagacttcatctaaaaaaaaaaaagaaaagaaaaccttgaatatttcttgtacttgtgttcaaatcatacagttatgaaagtttacccctagctgttacacttaaaatgtacttctgaaatatacagagagatgatacagactattaatgagttccactaaacttttaatggtttagaaaatacaaatattttcttatttttctggaattccagccattaatgtaaaacattggtttcaacataaataacacactggcatgcacatatgcctaagcatgggcccccacacatacagacattctgaaagaccactttttaaaaatattcagtaccgtatattgtgcattccttctttatccacatacttaagctgctgcaagcatcccattgataacaccagtaataaaagatgggaccatcagtaatgagatttgaaagccccttttgcaagaaagtaaggactagaaggtggaaatcactctgtcttagagtcatatggattggggctttgctagaagtgtgtgctctcagggaaagctgcctttttattttctccagagaaaagcctttttgtcagtaaaagaagatgtatcatccaatgcatatgtaaaattctaaacagcagataaaacaacattcactattaatctctgcaaaagaagatatattgaaaaaatcctcaagtgtccctctttgggtttctttgttatatattaaagcagttatctttagatgcatgagaatcacctgaagaccttatttttaaaattcagattcctgtcagttcactcccaaagattccgattcagtagttaagagacaaagcctaggaatgtgaatttacaatcaacacctcaggtgatagccatgcatgttcttaatgctctactactatctatgcataaaaggaagataaagttttaaaaacttgaaatgtggtataacagtttagtattgaataatatacatttttacttattgtaacaaattatgatatctacttggggcaacagtatcttttattttggatctgaatcctaattttggctaggtatcactgagggattcttagtctaaaacaattaaatggagttagtggttttttttagtaactcttgattttctgtttttttccattggcatcttacaaaatttattcattcatttttccctttttcacttggcattatttgttagacagtggacaaaagaactatagaaagtagagaagcatgtgatgttgtcctgctcttagattctcgcaactcaggagaggacattcgcttacaccaatcatctcaaaacatggcagtttatgctgaactcagtccaatgggagagcatttgactgagcacatagggagagaagttagctctgttgaaggataatcaacgaagaattcttaggaaaggtacagtcattcattgaatatttgctcggcacttactaggtgcatatgtgcactaagatctaaggatgggctgatgaagaacccaggtcccttttcttctagtggacatgcagactggcctaaaaaaaaaaaggtaactggaaaatggataaggaaactgagtcactcggtttatttattatcactcggtttatttgcttttgtttgtattttcattttgacacagcacagtgtcatcttaacgcatcctccaaagtgaaggatggggtggataacactttagttggcatttctgtagccaggagccaggatctttctcccataattgcattaacctgggaaggcaccctctaggtagatttgtatagcaccctggttaatcaattatcagtttacttcttgtctcactaagctttaacaccttacatttatgaagcagtgtaaatataactttagcatcttgatcacagcaagcacctgatttgtatttttttattagctcaagtgaaatcagatcagagaagtacattacaggtcataaaatatgtgcaaatttcataatgacctccttttaaaatgtgcaaaaataagattgttaaggcacattccagagccttggggggtgtgtgtgtgtgtgtgtgtgtgtgtgtgtgcgtgtgtgtgtgtgcttgtcttttgagaatatctgtatatcagaaaatttggctgagaagcaatcttcttcttagtggttctttttctcttttgaaaataaagtactaaaaatacttaaagatgcagaacagcaacctgttcccagtgagactctcgtttaattaatgtggtgatctatatagagaaaagggacaattgcaaaagtccctcaataattatctaaccacagtctttaggtaattacagcagaaagattttcaagacacaaaacaccctggaaaatttgacctcttattttgattcaggcctttcatttcttaaatattttctttaatgttgatgtttatgcttgacaaggtcagcctaatgccagatgaatccctggaactcaaaacattgctgaattcacagttgaaggattttaatataatataccagcttttaaaaatcctacagtgagaataacaggactgaataaaaaaattaagaaatgctcaggtagaaataaatagagaaatttagaaaaaaaataaaacgtattcaaaataagtattaagcattggcaaagaaaaaatagtagcagacaattacatgttccatttgtaaagatgattattaattagtggtcttgcaaaacattggagaaaatttgctgaaccatcacattcataaatattaaaaccacccattagtgaaaatctttttactaaacttcacaactgatagtcaaataatgttcagtttttctccattgcaataaaaaataaaggcttttgccttcagatcagtctctgggccttattaattcagtcagccagaagccacatggaaatattttgttttgttaaaagccagcttgccctcatgatcttttaaaatcttttaaaaatcttccatcagccctctccctgacttgaattatggcagtgctttctaaactggtaaactcaatctccttggtgtgcctcaagatagagtacataaaccctccttagaaattgagctctcaattctaaattgcactctccatgagagcaagcaagaatgctttgctttgtattaagtggtcacaatattaaatataaccatagacagcactgtattttctaaacaccttattttcttttaatgactgacataaattagatcataagtatacaaatgcatatctgttgtatttttcagcaccatgtgtttttttttcttttttctgagttattttcctgctttcggcagccttttctctcaggtgccttgtgatccacagtggtgtgtgttcacactaaccaaagcaatagtcttacctgccagaaatagctgtgacatttaaagagaggtccaggggaaggcacagtgcttaacatccaagtctgaagagctaatagtgaaattggggcatcagctacagagagatttaggggaagtaacaggcaggttaaatattttatggaaatgatttctgttctgtatatgattgcaattaacacatgtcaatctgtttcattaatttgttaactcatctattatgctatgccatgaagaaaataaaattggagttctttatttttttgagatggagtctcactctcttgcccaggctggagtgcagtggcaggatctcagctcactgcaatctccaccacccaggttcaagcgattcttctgcctcagccacctgagtaactgggactacaggtgcgtgcaaccatgcctggctaatttttgtatttttagtagagatggggtttcaccatgtgggccaggctggtcccaaactcctgacctcaagtgatccgcctgtcttggcctcccaaggtgctgggattacaggcgtgagccaccgcgccccgccacaaaactgaagttctaagcttcagtttagatgctcactaaatgcttgttttgcaatacctgactgtaactggcaggaatatgttttgaaagtcctcattttccaggtatgcagatgaaatataggggcattatctactatgtcaaattataatgatttatcagtggcacatgaaagtcgcctcacatttcttaatcagtgatataccattatgtcatgccaccttttaatgtaatatgtttacatctttctttagatgtaagcattcatttagttcatcacggtggctttcacacttactccaagaacgctatgagttcctttgatgtgctcaagtctcctgccccagggagaaagggagtggtgagcaggaatcgctttaatctatttacacagatattttcttttccatttattttaaaggaattttttttaacttaatgagtatgcagtgacggtggtgatgatgatgatactaaggtttaaatgattagatagtcaaatctgggctggaattgtaatactgttttgacttttaatcttagagaagctccagtctgcttattttctgggcataaacacatgagaacaataacacagttctgttatctgaatgttgttatattttgtttgaaacattcagtgactttcaaatattgtatttgcctaagaaaattcaacagagtcagacattctcttccaggttaaatttggtgagtctgctaggaaaataaattttgtgcactggtcattctgatctagtggacgttctaataaaagcacctttgtgctgcctacgtcttcactttaaagataagatacctgggtactcgacaccaaattatagtttgagatctcaaaaatgggatagggaaaccacagctcaaaaacaaaaatactagcactggaaaagatagaactagtgaagatgaatcattctctagactttaaattcagagatatcaaaattaagaaaaagtaggaggaataaaaaaagagggtaagcaaaacaatataagtttgtatagcaagagggtataaagcaaatacaatatttttcagaaaaattaaataaaaatagatttacataacattgtttttaatctcaaagatcaaatttcaattttcatctcattttaaaacccatatgcacagtctcctttatatacatcagttgggtgtcaaagtgacttttttcttgtttccaaatacagttatttttaaaatttaattgtatgatttaggaatttgaaagcaagccagtttgcacacacatatgttattatatgtgtgctttagacttggtttttagttaatgtaacatgacagggccacctgagttatttgtttacaaactagctggaaagccaccctggaggagaaacctggcaacaaaatggtctgcagctttgttattgttatctataggattggatgccattattgctgtaaaatagttcacaagaactcagtctatgggaaagactcaaaaattctttgcctgttaaagaaaaatcaggatattggactggttagtttaactaaaaagtgatgatactcagattctgcttggattcactgcttctcagcagttgttttgtttctttctaattgatattttatttttcagagaacccattataaaactcttcttcttcccttaaaatcacaaccacacaacagcaattaaaacatgctttgacgtaagactgatatggttttaaacccagcttgactatcgaattttttactttaggcaaaacacctctgacatttatgtcttatcgtcagtaaaaaggggtgattaacagttttacaagattattcaataaataaatataaattcctccttttccttcctttcctttcttcatcttcagcatctgcatgccataagctcattttagttctctggactcatgttaacatgtcccacctttcccaaattaaacatcatctctgttattggctccattcttttcctctcatttgagacaattctttatcaaccaacaccctctctgctctgtattgtgaaactctgctcctactacattaacagtctcttggtttctttaaaaagaagacaaaacaattaaagaacagaagcaaaaaatctactcaaatccccaattgttaccctcaaaattaattgtcccacccctagctttctcattgcacaactctttgtcaaaatgttttctaccatcacagccttcaatgatctttctggttcctttatctcctgaagtctgacttctacctccatctttttctggactattcaacacactttgagaaaaaacatacttttgttaaacaggtatgcatccctgaagcataaaatacatagtactgaaagtgcacatgtgtggttcttcccattttttttacagcacttgaaactgacaagtagtagtaccaattacttagtaaaagacctttttcatttcatttctgaaatattgttattttcctttttcatcttccatctctgactacacctccaattttacctctttgctgccttccttcctaagaaagttcttcatgcaatgccatcttgtttttcttcacttgcctctttttctcactttaattttatgaactctgatgacttacctctgtagtgtaactactcaaaatatgtatttctgaagtctcaactccaatctcatattttcaacttatatttatggaggcatctcagactcaacctacctaaaaaatggcttatctgccctaaaatctactttgttctttttttctctactgctaataattatcttcctagttggtcaagctcaaaacctaatcatttttactccttgtccctgtgtcagctgtccacattcaagcagcgtatcatttctgcacatttttcaagcaagtcagtaactgccttttgtttgggactgtcttttcatatagtgaacagccttggaagatagaaatcatttctccttctaaaacaaaaggcaggtgtgcttgcagccttggatagaggtagtgcctctttctaaagcaaagggacatctttactggccattataaaatatccatgtttcctgagctctgcgttcctcttttctaatgcaacccactgagcatgtaggtgtcacctgagcttttctgtgggaattgcggcttgaggaatcagtgcaagaaaatcatgatactcttgctaatgctattaatgtgagtagtaaagttaattgtctctgacccagcactattgtgtctttgcccagcactcaaaagactggcaggcttgcaagtaggacaaaatgttagatttttcacagttcttctgcttataagtacttgttaaaaccaattaaaacacaacttgtagtttgcacctataattttgtagcatttgcttcttatctatgtcactaggatgtgcttagtgacagacccatctatcatctattactcaagtttttggctgtattcctaggcaacagagagaaggggaacaaacaagaggacctgtgcacagtttgagaaaggcaaaacaccgagcttaattgcagacttgaatgtagctagcaaacgaagtaaggcaaaaggttccttttttttttttttagatggagtctcactctgtcgccagtctggagtgcagtggtgctgtctcggctcactgcaacctccgcctcctgggttccagcgattcttctgcctcagcctcccgagtagctgggactacaggcatgtgccaccatgcccagctaacttttgtatttttagtagagacggagtttcaccacgttggccaggatggtctcaatctcttgaccttgtgatccgcccattcggcctcccaaagtgctgagattataggtgtgagcctccgttcccggccaaaagtttccattttttaaatagttgggtttttagtttcgattctttccaaaaaaaggttttcttaaaaaaataaaattagcaataagatgaaatataacaacaatataatcttattaagacaatatatgatatacatttatcaaaatacttatattttcaaaagtgcttaaaataatctagcacatagtagatgctcagtaaatatttgatattatgactgtgcatgggtcattataggctactttatgtatatcatttcatttagtacaacatcactctgaaaaatgttttattgttaccgtttttcagttgaaacatttacgttgctcaagatctcactggtaccatctactattaggtcagtctgccaccaaatctcatgctcttaaatgccctttttctcctgagcttccaacaaatagtgtactgtatataattgttgaagggaggggactgtgagacaaaatatttagagtgaatgtgtagccacaatttcagttcctcaacaaagtgataaaattaggaatcatcctcaatatatattcttccaacacacacacacacatacacacacacacacacacaaataccacaagcccacttgaatgcaccccacctacacattgcaaccatagagacaattgcagcattaaatacagaatattctgtgtgttgtttgtttgttctccctttgctacaaaaatcagaatttctactcaataaacagcaaagggagatacaaatgaaccaaattaaagaaggaaaaaatgttgaaaaaattatatacagaactatgtattgatttattgagagttcagtaatgtaatccagaaataatggatgccttaaaagtaattaaaagaatgcaaataaacatttagtgccaattaaagaaaaagaaatacaacattagacaaaataaaagatattcatttgatgcaatgaggaaataatcttttattcctctttaaattctctgtggaataaggcatggttataaataaataaacatctgccccatggacttaatggatcgttatattttattgcgataatcataatgaaattgttgggagggattagtatctctagtgtaatgctaagaaagataaagcctgtgcccaggcaaaagctttcttggttggtcaaaaggtttgaagacatttcaaactattctaaaacaaacaaacaagcaaacaaacaaaaaacatacaatgtctttgccacatatttaggaaacaaaatgaacaatttatttctgacaacctcatagtctttgttctgtcagaacaataatggaaaggtctaaaccagaaaatgctatgcattgaatttataataaactattttttcctgtaacaaaaaattgataaacttgatatttgcagatttaatgattatgtgtttaaaaaaaatctggtttttgcccttgcaaaaaatcatatatatacacatagatatgtatgtgtgtgtgtgcatagtatatatatatgtatatacatatatatacacacatttatatatataaacatttcctttaacctcctattttattccaataaaaatattggtattagagatagttctgatatttcatcatgaatagttaacattgcatttggaaaggattaatttttttgaaacgtaattttaccttaataagtagcccagcgtaatattttagtaattacacagatttttttttcaagacatttgacaactaatattgcataatagttaagagtgtgggctttggagccagacttcctatctctgttcattcactgataaaatggagacagtagtaacttcctcaaagagttgttttttaagatcaaataatgcatataaaactcttgaaatggtaccaaatacagagtaagcaccaaataaacattaactgttattgttattccatgtccgaataacacagaaaagtaagaattttaatatttcatttgaatgaccttttaaggatacacctagcccattatctttcttgataatcttgtaagatgattccttttttatctccgatctgttgaggcatggatagaggttttcagagaaaacattttctaggtaactgaaagaaagtagcaacaacaaactgtgacaaaacttaacaatgagagaatttacaagatagaataattgcaactccttttgaaatcaaccactatggtcctctggctgggatagctaagcaaagatattccagcctgaaggttgagatctacttgaagagttttctatccagattgtgagggcccctcaaacttcacttagtatctgtttctattagtatggaaacttctggaaccttgtggtatcacattcacttgactactttattcctgctctagctatcttaaagcctttcttaatcttttatcttttagagaagatacttctaggttttaaatccaccgatcttgaagctattgccttcactctctgcttcagagcccatccttttgtatatgagtagtttgttttgcctaaagtactttctcccagtcagattttaagtccagtttctcatctgtttttgagagcaaactcctgggccttggctcactaacatcttgacagcatatttcttctttcctatgggcttttcagcattccctgggtttttctaaaatatgaaagcagactctttatctcttactttgtcaaagcctaccctccccactgatttctcacccagttgctagttttaagacctgcctctggccgggcgcagtggctcacgcctgtaatcccagcactttgggaggccaaggtaggtggatcacgaggtcaggagatcgagaccatcctggctaacacagtgaaaccctgtctctactaaaattacaaaaaaattagccaggcgtggtggtgagcgcctgtagtcccagctactcgggaggctgaagcaggagaatggcgtgatcccgtgaggcagagcttgcagtgagctgagatcgcgccactgcactccagcctgggcgacagagcgagactctgtctcaaaaaaaaaaaaaaaaaaaaaaaaaaaaaaagacctgcctccaaatatcattgtatttgcaaacatgaaatgacttattgattctgagctcagcacaagagcaaacctttctcagcttgacccatcttcacatcgttaatgtcttattcagtcactacccaaggggctgaccttcaagattctaatccatgaaagcttaaaatagtaaacaaatttgaatatagtttaacatacataataaattttatttctagaagaggaggatcagcccttagacatgaaaagtaaaaatagtttattcccagatttccctttgtgcattagtatattcaaccgagtctatccaagtaacaggacaaaaaaagctggcagttgttgctgcgctgtgaagtcttattaggtgagtcagctaattatatggcactaccataaatacagcaggcactgccctgcttgttaggcttgccaaggaaaataaggatttaaagcagcatactacctctttgctatataatgacattttcttcttaaaaatgattttgcaccaattcctgatttatccaccaattattttttaatttatggttgaatgtatttaaacctgaattcagagataaaactagtaaatagctccccaaaataaccccaaatatatttaatatattagctttactctctcctccactgccaaacctttaaaaactgaaataaattgtttttatttcatcttttctctttttctctctctctaaggtgattgccaagactaaagaaacagctagaagggcaaaagacaagaaaatcagtaagatagtaacagattatccaaagtagagcacggctcaggtgcagtggctcatgcctgtaatcccagcactttcggaggctgacgcaggaggatcacttgagtccaggagtttgagaccagcctgggcaacataatgaaacttcatctctataaaaaaaaaaaatttaaatagccgagcatggtggtgtaagcctatagtcccagctatttgggaggctgaggctggaggatcacttgggcccaggagttggagactacagtgagctatgattgtatcactgcattacagcctgggcaatagggcaagaccctgcctctaaacaaaagataaacaaagtagagcataaatggcttctaaatatatgttatttatgtgtaagactgggttctctaaaggtatcatttaattaaaatagatttgcattctcaatctgtaggtatggattatgtataatgtatttaagatatgacttacagcgttcaccaatgtgactattcccaagtgatccagatggctgatgacatagtaatttgtacatttgctgagacctgatctgagtaggtatgtaacataactgagggagagcaagtccatttgccgaaagaaagcctagcatatgacccaggagccacatcttcactcagccttgttgctaggtttggcttagcatatataatagcatagcatgtataatttatgacaaaaaattatactttgcactttttaattagaacattcaaaatgatctcaggaagtggcaccagagatcatcagtggtctactgtacttcgtgtgtatgtgtctgtgagtatgtatgtgtttgtgtgtgttcccacattctaaggcatgtcttttacaggttagtagaaaatgttgatagaaaattatagatttcaacatctaaaacacagtaggtcactacattgttaaaacttggaattttttatcttgttgtaaagtcaggccaaccaaacctaaaatactgctacattgaaatagtgcaaaatattcaaaatactatagttatagatttggtagtaggactgtaccagacctgtcactctatacaagacttatgccttgccctttcacttacctgttcccttttacatctatcttactagatgtaatgctataaattatatttctaatatattataatttatcatgtattataatgtatcaaatattacaaattatgttgcaactccccttacctttcgtctgcatattgcctcagaaagaacagatggatccaacagacttcaaccacaggcccttagtgacaaatagctcttaatgctgggcttgccactttgatgcatttctaaagttatagaatgttaaatgcaccaagtcctttggtcattttatttctaccttagatctaagccataactatactttcccaaaaattaaagtttgaattttaacttaaccatatataattggaaaaggaggttgggttcgttaagtgtaattttatcatgctttattatcctttgggcattggatacagcagaacatgccaatttctatggcttctcatgtgacagaatatacttactaggatgcaattaaatactcctcagagtatgtaaacaataaatgtaatcattacattatttttatattgttctttcttatgcataatagtaagactgaaaatatagtgttatttctgaaatatgcatattgttttgcttttgatgattaaataacattgtccaaagttttaggttttttgaaatcttatattttttaacaaaatatctagcctttccaaaacaagacctcaataattcgtttaagacccagagttgttcctctccacatagatctcttaaaaaggcagaggatttatgacctcaagagaaatcagagtatccaaagtttgctttaattcaatgttttaaaaataaaattccttagattttatcaaaaattgagattagtttgattttgaatcagatgccctttgctccccaccccaaaatggcattatgagcagactaggaattgataatagaaaattgaacatatgaaatatatctttaccttgctttttaacaaggtattcatgtctatcgccttcatttttaagtgcatcaataaaatacatggtaattctcttagtgaaatatactatctacactatgtacacactcccctgtctgaggtagagaagtagagaatattcacatttttgaaacgtctatgctatttttatttaaatacgagttctgggcttgatttcattttggaacacgggtgtgtgcttaagttgaacctttttttcctcttaagtcaaagttcttttttagtttcttcttttatctttttggctactatctctctccttcatcctcctggtgtgagttgttgagtgaaggtattaattccattatttgaggctaagtgacattgttcaataatgcagcaaaacaatggttctacccaaaatatcttcaagtgtaaaagcagtgggcaaaagagaaagtgcgcttctgctgctttgaatgtttaaggctgtgaaagttgatcacacaaattgggtcattcttgttatacccaactaaaacaatcaagaagcctgggaggaaaagcattcaagaaacatcacattgctccaaaagtgtaattttctacaagtccgcatgctgaggctgcctgttgtaacctgggaccaattttttctgtaactgctgaaaaaacttgctgcagctctaggactaattttgcccaccactgtcactcaccaattgaagcttactagctccccagaacctttctagtgccaatgaactttctcaaagagcagcgtgtatcatttctctttttcagaacacctccaacctcctctttgttctttgggtataccaaagaccaaccagccttgaatttcaatttttcttcccacataaaagttttaatttagaaatgtatctctacatttctaactttgacaaagcatagataccagataattgatgaaaccttgctattttaacgatcaccatggattacttcccagtgtcttcagataaccctcaacatttgccaacatttgatggacttcaaaatgagcatatcttttttaaaaaaaattattcacactgacagcaagtacattggtatactctatattaaattataccacagggtttacaaacaattggtgatgtcgggcagtggtttccaaggaacatacttaacaagacactcacaaggccctacaaacctgcatttttaacaagggccctagatgattctagaagagtgtggtttggaaagcaatttttgcctttattatgtgtcattttaaatatatttaaaattaaagttataagtcatagaattgaataaagataatttccttacagaaagtattactaggtatctaaatacaatatggttcaaaacaggaaatttaaaaagattatgtaaattctgtagttgtattcctaaagacagtagctgaaattttttcctacttctccttgtatcacttcccttttccttcactttcacttccctggaattgtacttcccaataagctattagcagtgaaggaagcttcgtctcatgatctgttttatagagcacttcagctgggacgagtacgaaatgataatcagttatatcagctattcaaccctacaggtttatttaaaaagaacttgaataagctttttagggagaaagaggtcagtctcagccatttctgtttcctaatatagcttttaagtctttccttattagcaatgagggtcattccattgtaattttttgataaccatttttctttctgtgtgtcaaatgcagatataagatactgaactgagtctatttcactgttcgtaaaacaatcccatttgaaaaaaaaaagtctacagctattccagggatagggcctagtagagagagaataaaaggtattttcttactatgtctctatatcctaccctgtaggttctcttattaagcatacaggcatataccaaaatccagacgtttttctcatttattttattgccctaacatattctgggttaatataatatcataatgaaaatttgagaaaaaattgattttttcaaaagtgtttaacatttgttatattggtagttttttttcttgtttgtggtaaaaataaatagaaggtgcacttcacaccttcaagtatgattatattttgaaaacaagtcatgaatactcataaaatgcaaattttaatgttctttttttgttacagccaaactatattaggcacagttgtaaattggagttgaaatttaatatttctttatagataacaatgtttttagaaataggtttatgaaacagtaaatatacaggtatagggataaaattgtgtctgatggtcatatgaagtgtttgttgttatattctccttggaatagctgccaaatattttagtatgcttaaaatctacgaatgtgatagagtcaacaaatttagatcacatattcagaaaaacatagttagagaactaactattgaaatgagcatacagcagtcttcctttatctacagggatacattctgaaacccccactaggacacctgaaattgcggatagtagcaaaccctacatatactgttttttccaatgcttatgtacctatgaaaaagtttaatttataaactaggcacagtaagagattaacaacaataactaataacaaaagagaacaattataataatatactgtaataaaagttatgtgggtatggtctcgctttctctttccctctctctctgtctctaaatatcttagtattttggggttgcaattggtggtgggcaactgaaaccatggaaaacaaaaccacggataaaaggagactactgtatatactttttaaaactgatgaaatattaaactcatgtttcttctatatcccacccatttcccccacccaaacctagatagatatcttatttgatctgtaaacatttaattaatttgtaaaagttaagaactttttgaagtaaaactgcaatatatcatcacacctaaagaaataaacaataattcttaaatatcaagtcagtgttcaaatttccccaactacctcatatgtgttttccatttgcttatgtagggttcccaatgagaatgaaataaagttcttaggttgcaattggctaatgctctctcacttctactttaagcggcaggttcccactaacttctttttagttgcaatttacttattgaaattagacgtattctttgtcttgtgtagtttctcacagtgcaaaatttgctgattgtagccactgttgtaagcaatgaacatgtttttcaccaccttatatttgctgtaagttgtcagtgatagttaaatgttaatcaaattcaaattcggatcacgtagggcttttctttttttgttttctttttctatttatatatttatttatttattttgagacggagtctcactccgtcaccaggctggagtgcaatggtgtgatctgggctcactgcaatctccacctcccgggttcaagtgattcccctggctcagtctcccgagtagctgggactataggagaaccaccacgcccggctaactttttgtattttagtagagatggggtttcaccatgttggccaggatgctatagatctcctgacctcaccgatcatgtaggacttcaattgtcgaacaaacgaacctttaatagcagttacaccattaggatgacctgatccaacatcgaggtcgtaaaccctattgtcgatttggactctagaataggattgtgctgtcatccctagtgtagcttgttcccacttgatgaagttattggatcagtgaacaatagcccacttaaactagtacagtcttagtttaagatggtgatgtgtatgtacttccatcagagggcacataatacagtaaatcctcacttaacttcatcaatagtttctggaaactgtgacttgaagcaaaacaacatataacaaaaccagttttaccattggctaattgatataagcaagaattaagtcctatggcaaatttctggacacaaaaacaccatcaaactcctaaataaagataaatcacttctgacattaaacattgaaattaatgtgagctatatatacgtttaagaaagattaatacaaacaagtcaaataacttacctaattatttcggtggaggccgcaggtggttggagcctatcctggcagctcagggagcaatatgggaacccaccccggacaggacgctgttccattactgcagggtgctcttgtacacacccactcacccaggctggaaccatgcagacacacacactcacctaacctacacatctgtgtacatccttcaaagttcagccaaataacatataaacaaatccagtaatatccatcagtcttagttccgtcataacaactcctttttgatcatcaaacaacaaacagggtaggtctgccatatttacttgtctggtccatatcaaaattttctaacaaattatattagaaaatcaaatctctgtcagtttcaaaatcatggaaaaaaatttgccttatttcccttatacttggatatcctaacagtaatctaaatattaatgagaaagttaatgatgtcgtttccttctccctgttgtaaagaaggttttgctgtcccgtttgatcactaagactaattgacactcagaaaaagcataggaaacttctcagcatcacaaaagctctgtcatctagagaagctaggacttgagctcaagtcctgtgacatggaaggccttgtgcctagccatcctgcagcagaggcgtatctaccaagaagtgaaacactacgaaaacagtatgtttactccacattttaaagtgaggtagtttggggtggttcatattttatttaatttatatattatttggattttttttagtttataaaaagggcattggcaagggcagaatgatctgtaagcttctctgcccacctaccataagcatgatctttagtgtgaccttttcttactgttagccattttcttatacttctgcgtccctgtcagtcacttccatgtgaagacatggggaagcttttttacatcagacatgttgttgaaaatcagccgcgttggctgagggattatttgatctctttctccaagtccctttaggctcacattgcctctctgttctttgaattttcacttacctttatcttcttataattactttgctgaaataaatgcaaagcaacaaaaggtatttagtgaagaataccaacaaagccatgaccatttcaggctgagttttgtagtattctttgtctaggaagagatacctagaaaaattttctgaccatgtatttgattattttccttcaatatgtatagtctcagtcttcaaatttcagaaaagaatttgtttcttcattgtcatttaaaattaatgtgttaaatatgtatgcttttacattataagtggttataaaagttaaacacttagaaaaaaagtcaaaataacatacatactatccaacaaaataactttcatattttattgtgttttcttccaaactttttacctttgcgtctgaattctgtgtaggttgtatctataatatagacaacactttatagcctgctaaatattataccataaataggtagttgttacataattctcaggtaatagtaatacaggtctttatcataatctactgagtagttgaatgataattttttttaagacaaggtctccctctgtcacccaggctagaatgcagtggcatgcacatggctcactgtagcctctacctcccaggctcaagtgatcctcctgcctcagcctcccaagtggctgggactgtaggcatgtgccaccatgcccagctatttatttgtatttttagtagagatggggtttcattgtaacagcccaggctggtcttgaactcctggactcaaatgatccacctgcctcagcctcccaaagtgctgaaatcacaggagtgaaccactgcacccagcaataattttttaactcttcattattcattgaacatttagttaacaattctaaaaattttgtttcctgctgtcattgatcttgtgaaaaatatctttggactatagctgtggattatttcctaaatagtaaattacttgagcaaaaagtttacatactttgagggttgataacccatgttgccgcaatgtttccccggaggcattgtggagtttagaatgccagtagtaatattaaggtgtgccattttcaagatccgtggccaacatccctatatgtaagatttttccaaaacatggttctgatttttaaaagtgaaaaatgctacttcatcatgttctttttgtgcttcttactttaaatattagaatgaagaaggagccccacaggaaggaattctggaagatatgcctgtggatcctgacaatgaggcttatgaaatgccttctgaggtaggagtccaagctgaatctttctaacaagacagtaccaaaaacctgtcattgtcacatttctctttcattagtgcttagtgagaatcatttgctctctacatgctcattacgtggacaacttgcaagttaagaatagtttttacatttttaaagggtccttaaaaaaaaagaggaggaggaagatgaagaagaggaagaaaggatgtaaaagaaatcatatgtagtccacatagcttaatatacttactacttgaccctttacaggaaaagtttactaacccctgcattagagaatatatttttagaaactttacattctaaaataaatttctaaatggaaagttagggaaatcaatggaatgccaaaggaaggttattattttttgccatacatgtccaatgggatgacgcatagtaaaataaaagttacccacacaagttatagaataaaaagataaatgcatgatttgcgacaattgatatattccagtataatgttttaaacaacacaatatgattgttaattttattttgattgaaaatgaaagtatctttaatagaaaatgtatcaaaagggaaattagaaaatactgttagatgaataaaactggcccaagaagaaacagtaaatctgaatagatttgtaacacagcgaatagattaaattagtaataaaaaaaaaaacctacctgcaaagaaaatcccaggccgagatggcatcactggtaaattctaccaaacatttaaagaggaattaatactaattagttaacaccaattaatatctcttacaaaacagaagaggagacatttcccaactaattttgtgagaccaatattaccctgataatcaaaaccaaatgaagatatcacaagaaaagaaactatataatggctccattaaaaattgagttcaagtatgttgtagtttggttatgtattattcctcacggcattattaaaaggcatgtcgaggatgggcacagcagttcacacctgtaatcccgcactttgtgagccaaagtggccaggttacttgaggccaggagttggagaccagtctggccaacatggtgaaaccccatctctactaaaaatacaaaaattagccgggcatggtggtacacgcctatggttccagctacttgggaggctgaggcatgagagtcacttgaacccaggaggcagaggttgcagtgagctgagatggcacccctgcactccaatcttggtaacagagcaagactgtctcacacagacacacgaaaggcatattgataataattcaacttatagaaattgagattaaattgtttgtttgcctaataagaatttccaatattttggggtcttttatgcaagacacagtactaaacacaatggaaaactatagagtaattgacattaccaggacataaggagtttacagtctggtaggtttgatgaaaaaaaatagaaattcattcattcatttcttcattatgattcctttaacaaacataattgattgtcttcgatgtaccaggcatcacaggagcaaaaatatataagacatactaaaaagtaaaacattttaaagatctgtttcaatcaatcaggagaagttttattgaggaggtaatgttgatctgggtgggaaaaggtaagagatatagtaggtcaaaacaaacagaggacattctggcacaagggaatatcagaagcaaaggcatgtatgtctgagcatgcaaatggatatgtctgagaacagtgaataattatgactcaagcttaggaacaaggaaaatggtgatagattgaatttgcagctatgggtcaaagacaagttatagagtattaggataatcttgtcatttcagcttgtattctattcagaaaacaacttgagttattgaagttatgcttatttgtttgtttttaagcagaatcctgatattattagagttgctctttaggaggaataatctgatccctttaattaaatccattaatatttgtgttgtggatgctatccagatactgtatggagagcttgaggtttgaaatacaagtaataattgaagccatagatgaagacgaaattttcaactgggagagtgaaagtagggaaaatgtatcttgccttcaaacatcttaatttccttctgagaattagagcatcttagtctggaaaaggctttatagacagcttgattttgttctcacattttacaggtgaagaaactgagaaccagacagtccaacttatttgtcctaccaaactaggtatatgatcattaaatggtgcatccggatcagaacctagatattttaactctgactactactgtaattcacttttatatcagacaagaaagacacaactattaaaaataagataatatttgctgcagaatatttgcaaaaacattgattgtaaattttagtgtaagtggggagccatttcctatctcattggctgtcagtgctgatgcgtaattgaaacttatactaacagtgtgtgctgtctttttgatttttctaatattaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaatatgtatttggtttctgcctccagttcttacaaagagctcctaaaacccttgtaatttcctgagtagtaggggtgctagggtcatcttttgttctaatatttggtctttgactctgctttctgacagagctccttagtccctgggtgagagtagcatcttctcttctaatgaagtgactcttgctgggttcctggatgggggctggtcaccagaaaggtcaagccatgataagaagcttgaagcttttggccccattcacatcttctggggacgggagagaagaggagctggagattgagttaataagcaacaatgcttccatgatgaagactccataaaaatccctaaaagacaggattcagagtgctttgaaataggtgaacatgcagaggtgctgggaattgtggtgtgtccagagaaggcatgcaagctccccacgcctcccccatacctttccctgtgcatctcttccatctggctgttcctgagttgtatccttttataacaaactggtaatctagtaagcaaactgttttcctgaagtctgtgaatcacactagcaaattatcaaacctgaggagagggccgtggagaccttggatttgtagacaagtcaaacagaagctatgagtaacatgaggactcattgcttgtgattgtcatcttcagtgggaaggggaaaaatcttgtaaaactgagtccttaacctgtgggtcaatgctaactccaggtagatagtgtccgatttgaattacgggacacccagttggtagccacaaagaatgggagaattgcttggtgtagaaaacacaccccacacacacatgtggtgtcagaaatgaaccggaaatattgtgttccggaaatattgagtgttgtgagtgagtgtatagaaagaaaaacagcgtttccttttcactactagattaaaacaaacacactcatgcattcacacatctcaaagacaactattaattctcaaagacagtgctgtctaaatccatactgaggaagaaaacacattttcttttcaaatctgtaaacctgacagactgcctctgtccacacactaatggaactctgtgtttcatctgaaatgtgttcatcccactttgttctttctgtcttgggcagggcaagagtgcaacagggctgacattttcatatgagctctgtccctgttattggctatactttagacaaattattatgtgtcaaatatagatgtaagtgatttatcaatattaagtcatttaattctcaaaacaaccttaataggttccattatgattctaattttacacataagccaaaggaggcacccacaggctagataactttcccacggccacacagctagtaagcggcagagccaagaggcccaacattacagcaccacagtctgtgctctcagccccttggccacatagtgtcagagtgaggacacacagctatttaagaaaacttccagaagtctaggaaatggggtgatagccccacttttctaggtataataattagatatttgtttttcttcaggtacctaaagaaaatttactagagtttgagcctttagtaagttttgctagtacatctgtttttcttcaggtgcctgaagacaaacatatacacacacacacacacacaaacacacacaaaatgtgtatctatatatatgtgtacacatatctctcatctctatatatatgtctctgtatatctatatatctataaacatatctatatctatagatacatatagagagatttctttttttttttttttgagatggagtcttgctcttgccacctaggctggagtgcaatggcacaatctcagttcactgcaacctccgcctcccaggttcaagcgattctcctgcctcagcctctcgagtaggtgggattacaggaacacaccaccttagcccgactaatttttgtatttttagtagagacagggttcaccacgttggccaggctggtctcaaactcctgacctcaggtaatccacctacctcggcctcccaaagtgctgggattacaggtgtgagccaccatgcctggccaagatttctaattctaagagaaattagcacctgataggtatttccttgtaaataaaccgggcatatcctgattatagaactaagttaattattttccgtggaagatacgaatgttgatgcaataagagcagcagtctacagtaaggtgggctttgtaattttctgtgttgaatcatggcatgggtacttggcttatgtcaaatagacaaaaaaatataaattaaggtataactgggattgtcaattatacatatttagtaatggaatgaatgaatttataaatagatagtaaagggcatgaattaagaatctataggtataaataatattagcaacttaatattgtataataaagtttgattttctaggtgtagttgattgatgcagtaatgttcgttttatcctttgagtaagcctagaattgaagaacccaaaatgcaatagaatagatataacattgaaactattcctaaatatgattttagttccaatgttctttgtgtaattacctaagcttttctttaatgtttttgctgctactacagtatccttaattatttgaaatcttatattggaagcagttaaaccacattccttcaaagagcccttagtttgagcctctagtaagttttgctagtataatttggttt

SEQ ID NO: 3 - DNA, 3089 bp, Homo sapiens
aggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaata

SEQ ID NO: 4 - DNA, 1208 bp, Homo sapiens
agagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactattttttgttgctgttgaaaaaaaaaaaaaaaaaaaaaaaaaaaaaaaaaaaaaaa

SEQ ID NO: 5 - DNA, 3022 bp, Homo sapiens
attctggtgtgatccaggaacagctgtcttccagctctgaaagagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaata

SEQ ID NO: 6 - DNA, 364 bp, Homo sapiens
gagaaggagaaggaggaggactaggaggaggaggacggcgacgaccagaaggggcccaagagagggggcgagcgaccgagcgccgcgacgcggaagtgagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaa

SEQ ID NO: 7 - skipped

SEQ ID NO: 8 - DNA, 18 bp, Artificial sequence
  Primer
ggagcagggagcattgca

SEQ ID NO: 9 - DNA, 22 bp, Artificial sequence
  Primer
ccttcttcattcttgcccaact

SEQ ID NO: 10 - skipped

SEQ ID NO: 11 - DNA, 26 bp, Artificial sequence
  Primer
acgaacctgaagcctaagaaatatct

SEQ ID NO: 12 - DNA, 24 bp, Artificial sequence
  Primer
gagcacttgtacaggatggaacat

SEQ ID NO: 13 - DNA, 30 bp, Artificial sequence
  Probe
tgctcccaagtttcttgagatctgctgaca

SEQ ID NO: 14 - DNA, 19 bp, Artificial sequence
  Primer
tggcagaagcagcaggaaa

SEQ ID NO: 15 - DNA, 21 bp, Artificial sequence
  Primer
tccttggttttggagcctaca

SEQ ID NO: 16 - DNA, 17 bp, Artificial sequence
  Probe
caaaagagggtgttctc

SEQ ID NO: 17 - DNA, 23 bp, Artificial sequence
  Primer
gtcattgcacccaatctcctaag

SEQ ID NO: 18 - DNA, 21 bp, Artificial sequence
  Primer
gactgggcacattggaactga

SEQ ID NO: 19 - DNA, 24 bp, Artificial sequence
  Probe
cggctgctcttccatggcgtacaa

SEQ ID NO: 20 - skipped

SEQ ID NO: 21 - DNA, 20 bp, Artificial sequence
  Synthetic oligonucleotide
tccttggcctttgaaagtcc

SEQ ID NO: 22 - DNA, 20 bp, Artificial sequence
  Synthetic oligonucleotide
ccaacatttgtcacttgctc

SEQ ID NO: 23 - DNA, 17 bp, Artificial sequence
  Synthetic oligonucleotide
tttaattacttccacca

SEQ ID NO: 24-27 - skipped (4 entries)

SEQ ID NO: 28 - DNA, 20 bp, Artificial sequence
  Synthetic oligonucleotide
aattcctttacaccacactg

SEQ ID NO: 29 - DNA, 20 bp, Artificial sequence
  Synthetic oligonucleotide
gaatacatccatggctaatg

SEQ ID NO: 30 - DNA, 17 bp, Artificial sequence
  Synthetic oligonucleotide
tagtcctcctccttctc

SEQ ID NO: 31 - DNA, 17 bp, Artificial sequence
  Synthetic oligonucleotide
tgcagcccgcacgcacc

SEQ ID NO: 32 - DNA, 17 bp, Artificial sequence
  Synthetic oligonucleotide
ttacaccacactgtcgt

SEQ ID NO: 33 - DNA, 17 bp, Artificial sequence
  Synthetic oligonucleotide
gaattcctttacaccac

SEQ ID NO: 34 - DNA, 17 bp, Artificial sequence
  Synthetic oligonucleotide
tacatccatggctaatg

SEQ ID NO: 35 - DNA, 17 bp, Artificial sequence
  Synthetic oligonucleotide
cctttgaaagtcctttc

SEQ ID NO: 36 - DNA, 17 bp, Artificial sequence
  Synthetic oligonucleotide
ccctccttggcctttga

SEQ ID NO: 37 - DNA, 17 bp, Artificial sequence
  Synthetic oligonucleotide
gagcctacatagagaac

SEQ ID NO: 38 - DNA, 17 bp, Artificial sequence
  Synthetic oligonucleotide
ctccttggttttggagc

SEQ ID NO: 39 - DNA, 17 bp, Artificial sequence
  Synthetic oligonucleotide
gccacaccatgcaccac

SEQ ID NO: 40 - DNA, 17 bp, Artificial sequence
  Synthetic oligonucleotide
ttgtcacttgctctttg

SEQ ID NO: 41 - DNA, 17 bp, Artificial sequence
  Synthetic oligonucleotide
cctccaacatttgtcac

SEQ ID NO: 42 - DNA, 17 bp, Artificial sequence
  Synthetic oligonucleotide
tcacacccgtcaccact

SEQ ID NO: 43 - DNA, 17 bp, Artificial sequence
  Synthetic oligonucleotide
caatgctccctgctccc

SEQ ID NO: 44 - DNA, 17 bp, Artificial sequence
  Synthetic oligonucleotide
gaattccttcctgtggg

SEQ ID NO: 45 - DNA, 17 bp, Artificial sequence
  Synthetic oligonucleotide
cttgatacccttcctca

SEQ ID NO: 46 - DNA, 17 bp, Artificial sequence
  Synthetic oligonucleotide
cttgtacaggatggaac

SEQ ID NO: 47 - DNA, 17 bp, Artificial sequence
  Synthetic oligonucleotide
ttcgagatacactgtaa

SEQ ID NO: 48 - DNA, 17 bp, Artificial sequence
  Synthetic oligonucleotide
atggaagacttcgagat

SEQ ID NO: 49 - DNA, 17 bp, Artificial sequence
  Synthetic oligonucleotide
tcacttcagtgaaaggg

SEQ ID NO: 50 - DNA, 17 bp, Artificial sequence
  Synthetic oligonucleotide
cacacaaagaccctgct

SEQ ID NO: 51 - DNA, 17 bp, Artificial sequence
  Synthetic oligonucleotide
cacaaaatccacagcac

SEQ ID NO: 52 - DNA, 17 bp, Artificial sequence
  Synthetic oligonucleotide
aatttgttttaacatcg

SEQ ID NO: 53 - DNA, 17 bp, Artificial sequence
  Synthetic oligonucleotide
tggtagtcacttaggtg

SEQ ID NO: 54 - DNA, 17 bp, Artificial sequence
  Synthetic oligonucleotide
tcttataatatatgata

SEQ ID NO: 55 - DNA, 17 bp, Artificial sequence
  Synthetic oligonucleotide
catagtttcatgctcac

SEQ ID NO: 56 - DNA, 17 bp, Artificial sequence
  Synthetic oligonucleotide
ttctcaccatttatata

SEQ ID NO: 57 - DNA, 17 bp, Artificial sequence
  Synthetic oligonucleotide
tattattaaagtgagat

SEQ ID NO: 58 - DNA, 17 bp, Artificial sequence
  Synthetic oligonucleotide
tttgtcctttgtgtcag

SEQ ID NO: 59 - DNA, 17 bp, Artificial sequence
  Synthetic oligonucleotide
tccgagtgtagggttaa

SEQ ID NO: 60 - DNA, 17 bp, Artificial sequence
  Synthetic oligonucleotide
aatcacagccacttaag

SEQ ID NO: 61 - DNA, 17 bp, Artificial sequence
  Synthetic oligonucleotide
acatcaaacaacagttc

SEQ ID NO: 62 - DNA, 17 bp, Artificial sequence
  Synthetic oligonucleotide
aggtacagcattcacac

SEQ ID NO: 63 - DNA, 17 bp, Artificial sequence
  Synthetic oligonucleotide
catggtcgaatattatt

SEQ ID NO: 64 - DNA, 17 bp, Artificial sequence
  Synthetic oligonucleotide
aaggagggtgtagtcaa

SEQ ID NO: 65 - DNA, 17 bp, Artificial sequence
  Synthetic oligonucleotide
aagttaaccacattctc

SEQ ID NO: 66 - DNA, 17 bp, Artificial sequence
  Synthetic oligonucleotide
ggtagttccaacgatgt

SEQ ID NO: 67 - DNA, 17 bp, Artificial sequence
  Synthetic oligonucleotide
caacatttaaaggaggc

SEQ ID NO: 68 - DNA, 17 bp, Artificial sequence
  Synthetic oligonucleotide
ttttcagcacccatggg

SEQ ID NO: 69 - DNA, 17 bp, Artificial sequence
  Synthetic oligonucleotide
gtgacttttagaaatga

SEQ ID NO: 70 - DNA, 17 bp, Artificial sequence
  Synthetic oligonucleotide
ctcatgaatacatataa

SEQ ID NO: 71 - DNA, 17 bp, Artificial sequence
  Synthetic oligonucleotide
ttctatggtaaccatcc

SEQ ID NO: 72 - DNA, 17 bp, Artificial sequence
  Synthetic oligonucleotide
tagtgtaagatgacaca

SEQ ID NO: 73 - DNA, 17 bp, Artificial sequence
  Synthetic oligonucleotide
actgttcaataacaaat

SEQ ID NO: 74 - DNA, 17 bp, Artificial sequence
  Synthetic oligonucleotide
tcctctatttcttaatt

SEQ ID NO: 75 - DNA, 17 bp, Artificial sequence
  Synthetic oligonucleotide
taaattcatggtcacaa

SEQ ID NO: 76 - DNA, 17 bp, Artificial sequence
  Synthetic oligonucleotide
aaaattaccgtcagata

SEQ ID NO: 77 - DNA, 17 bp, Artificial sequence
  Synthetic oligonucleotide
aggcttatatgacttaa

SEQ ID NO: 78 - DNA, 17 bp, Artificial sequence
  Synthetic oligonucleotide
gattgatcctcaggcca

SEQ ID NO: 79 - DNA, 17 bp, Artificial sequence
  Synthetic oligonucleotide
accgtggagtcatatga

SEQ ID NO: 80 - DNA, 17 bp, Artificial sequence
  Synthetic oligonucleotide
acacattagattgttct

SEQ ID NO: 81 - DNA, 17 bp, Artificial sequence
  Synthetic oligonucleotide
gaaacatgtttgcatct

SEQ ID NO: 82 - DNA, 17 bp, Artificial sequence
  Synthetic oligonucleotide
ggcgacgcgaggctggg

SEQ ID NO: 83 - DNA, 17 bp, Artificial sequence
  Synthetic oligonucleotide
acaattcccaaataata

SEQ ID NO: 84 - DNA, 17 bp, Artificial sequence
  Synthetic oligonucleotide
gacagctgttcctggat

SEQ ID NO: 85 - DNA, 17 bp, Artificial sequence
  Synthetic oligonucleotide
accaagagagcgggcag

SEQ ID NO: 86 - DNA, 17 bp, Artificial sequence
  Synthetic oligonucleotide
aaagaatgccactaggc

SEQ ID NO: 87 - DNA, 17 bp, Artificial sequence
  Synthetic oligonucleotide
tacaggtgcagttatat

SEQ ID NO: 88 - DNA, 17 bp, Artificial sequence
  Synthetic oligonucleotide
gcctgtgacctgtgctt

SEQ ID NO: 89 - DNA, 17 bp, Artificial sequence
  Synthetic oligonucleotide
gacatctctaacataaa

SEQ ID NO: 90 - DNA, 17 bp, Artificial sequence
  Synthetic oligonucleotide
aacagattccagcagag

SEQ ID NO: 91 - DNA, 17 bp, Artificial sequence
  Synthetic oligonucleotide
gatggatattgactcct

SEQ ID NO: 92 - DNA, 17 bp, Artificial sequence
  Synthetic oligonucleotide
tatatgcatttttcagg

SEQ ID NO: 93 - DNA, 17 bp, Artificial sequence
  Synthetic oligonucleotide
agacactcttacttgag

SEQ ID NO: 94 - DNA, 17 bp, Artificial sequence
  Synthetic oligonucleotide
tgaaggacaactgtgta

SEQ ID NO: 95 - DNA, 17 bp, Artificial sequence
  Synthetic oligonucleotide
gacatctgaagtgttca

SEQ ID NO: 96 - DNA, 17 bp, Artificial sequence
  Synthetic oligonucleotide
ataaccaccactgaatt

SEQ ID NO: 97 - DNA, 17 bp, Artificial sequence
  Synthetic oligonucleotide
ccatgctacattgctca

SEQ ID NO: 98 - DNA, 17 bp, Artificial sequence
  Synthetic oligonucleotide
gaaagaacaatgtcatc

SEQ ID NO: 99 - DNA, 17 bp, Artificial sequence
  Synthetic oligonucleotide
acaaacccaaagagatt

SEQ ID NO: 100 - DNA, 17 bp, Artificial sequence
  Synthetic oligonucleotide
gtccccaatccccaccc

SEQ ID NO: 101 - DNA, 17 bp, Artificial sequence
  Synthetic oligonucleotide
tcctatagagatgaagt

SEQ ID NO: 102 - DNA, 17 bp, Artificial sequence
  Synthetic oligonucleotide
tatccactctcctatag

SEQ ID NO: 103 - DNA, 17 bp, Artificial sequence
  Synthetic oligonucleotide
tccttgaaaacttccat

SEQ ID NO: 104 - DNA, 17 bp, Artificial sequence
  Synthetic oligonucleotide
gaggtcaaattttccag

SEQ ID NO: 105 - DNA, 17 bp, Artificial sequence
  Synthetic oligonucleotide
gagtgacagtggtgggc

SEQ ID NO: 106 - DNA, 17 bp, Artificial sequence
  Synthetic oligonucleotide
gtcctcctcctcctagt

SEQ ID NO: 107 - DNA, 17 bp, Artificial sequence
  Synthetic oligonucleotide
ggcttgaaggcaaggcg

SEQ ID NO: 108 - DNA, 17 bp, Artificial sequence
  Synthetic oligonucleotide
tttacaccacactgtcg

SEQ ID NO: 109 - DNA, 17 bp, Artificial sequence
  Synthetic oligonucleotide
atgaattcctttacacc

SEQ ID NO: 110 - DNA, 17 bp, Artificial sequence
  Synthetic oligonucleotide
atacatccatggctaat

SEQ ID NO: 111 - DNA, 17 bp, Artificial sequence
  Synthetic oligonucleotide
ggcctttgaaagtcctt

SEQ ID NO: 112 - DNA, 17 bp, Artificial sequence
  Synthetic oligonucleotide
agcagccacaactccct

SEQ ID NO: 113 - DNA, 17 bp, Artificial sequence
  Synthetic oligonucleotide
ttttggagcctacatag

SEQ ID NO: 114 - DNA, 17 bp, Artificial sequence
  Synthetic oligonucleotide
ccctccttggttttgga

SEQ ID NO: 115 - DNA, 17 bp, Artificial sequence
  Synthetic oligonucleotide
tgccacaccatgcacca

SEQ ID NO: 116 - DNA, 17 bp, Artificial sequence
  Synthetic oligonucleotide
atttgtcacttgctctt

SEQ ID NO: 117 - DNA, 17 bp, Artificial sequence
  Synthetic oligonucleotide
gctcctccaacatttgt

SEQ ID NO: 118 - DNA, 17 bp, Artificial sequence
  Synthetic oligonucleotide
gtcacacccgtcaccac

SEQ ID NO: 119 - DNA, 17 bp, Artificial sequence
  Synthetic oligonucleotide
agtggctgctgcaatgc

SEQ ID NO: 120 - DNA, 17 bp, Artificial sequence
  Synthetic oligonucleotide
catatcttccagaattc

SEQ ID NO: 121 - DNA, 17 bp, Artificial sequence
  Synthetic oligonucleotide
cttaggcttcaggttcg

SEQ ID NO: 122 - DNA, 17 bp, Artificial sequence
  Synthetic oligonucleotide
ggaactgagcacttgta

SEQ ID NO: 123 - DNA, 17 bp, Artificial sequence
  Synthetic oligonucleotide
cttcgagatacactgta

SEQ ID NO: 124 - DNA, 17 bp, Artificial sequence
  Synthetic oligonucleotide
tgatggaagacttcgag

SEQ ID NO: 125 - DNA, 17 bp, Artificial sequence
  Synthetic oligonucleotide
ctaccatgtattcactt

SEQ ID NO: 126 - DNA, 17 bp, Artificial sequence
  Synthetic oligonucleotide
gcacacaaagaccctgc

SEQ ID NO: 127 - DNA, 17 bp, Artificial sequence
  Synthetic oligonucleotide
gccacaaaatccacagc

SEQ ID NO: 128 - DNA, 17 bp, Artificial sequence
  Synthetic oligonucleotide
aggtgtttttaatttgt

SEQ ID NO: 129 - DNA, 17 bp, Artificial sequence
  Synthetic oligonucleotide
ttagaaataagtggtag

SEQ ID NO: 130 - DNA, 17 bp, Artificial sequence
  Synthetic oligonucleotide
acacctaaaaatcttat

SEQ ID NO: 131 - DNA, 17 bp, Artificial sequence
  Synthetic oligonucleotide
atttataggtgcatagt

SEQ ID NO: 132 - DNA, 17 bp, Artificial sequence
  Synthetic oligonucleotide
ttaattctcaccattta

SEQ ID NO: 133 - DNA, 17 bp, Artificial sequence
  Synthetic oligonucleotide
tttattattaaagtgag

SEQ ID NO: 134 - DNA, 17 bp, Artificial sequence
  Synthetic oligonucleotide
gctattaataactttat

SEQ ID NO: 135 - DNA, 17 bp, Artificial sequence
  Synthetic oligonucleotide
cttcagggaattccgag

SEQ ID NO: 136 - DNA, 17 bp, Artificial sequence
  Synthetic oligonucleotide
tttcaataattaatcac

SEQ ID NO: 137 - DNA, 17 bp, Artificial sequence
  Synthetic oligonucleotide
ggctcaattaaaaatgt

SEQ ID NO: 138 - DNA, 17 bp, Artificial sequence
  Synthetic oligonucleotide
tattgtcagaaaggtac

SEQ ID NO: 139 - DNA, 17 bp, Artificial sequence
  Synthetic oligonucleotide
ttattcatggtcgaata

SEQ ID NO: 140 - DNA, 17 bp, Artificial sequence
  Synthetic oligonucleotide
tatggctctctaaggag

SEQ ID NO: 141 - DNA, 17 bp, Artificial sequence
  Synthetic oligonucleotide
tgagttaaacaaagtta

SEQ ID NO: 142 - DNA, 17 bp, Artificial sequence
  Synthetic oligonucleotide
aaggtgactctggtagt

SEQ ID NO: 143 - DNA, 17 bp, Artificial sequence
  Synthetic oligonucleotide
catatatttggcaacat

SEQ ID NO: 144 - DNA, 17 bp, Artificial sequence
  Synthetic oligonucleotide
ccatcaagtttattttc

SEQ ID NO: 145 - DNA, 17 bp, Artificial sequence
  Synthetic oligonucleotide
actttctactagtgact

SEQ ID NO: 146 - DNA, 17 bp, Artificial sequence
  Synthetic oligonucleotide
atatcacattactcatg

SEQ ID NO: 147 - DNA, 17 bp, Artificial sequence
  Synthetic oligonucleotide
gtaaaaaaggaagtttc

SEQ ID NO: 148 - DNA, 17 bp, Artificial sequence
  Synthetic oligonucleotide
ccatttctctctagtgt

SEQ ID NO: 149 - DNA, 17 bp, Artificial sequence
  Synthetic oligonucleotide
tcctgaaatatactgtt

SEQ ID NO: 150 - DNA, 17 bp, Artificial sequence
  Synthetic oligonucleotide
gtctagttctgtcctct

SEQ ID NO: 151 - DNA, 17 bp, Artificial sequence
  Synthetic oligonucleotide
cacataaatccttaaat

SEQ ID NO: 152 - DNA, 17 bp, Artificial sequence
  Synthetic oligonucleotide
ttcactgctcaaaaatt

SEQ ID NO: 153 - DNA, 17 bp, Artificial sequence
  Synthetic oligonucleotide
gcttcctgaaaaggctt

SEQ ID NO: 154 - DNA, 17 bp, Artificial sequence
  Synthetic oligonucleotide
acctaggactggattga

SEQ ID NO: 155 - DNA, 17 bp, Artificial sequence
  Synthetic oligonucleotide
tggtaaagccgaccgtg

SEQ ID NO: 156 - DNA, 17 bp, Artificial sequence
  Synthetic oligonucleotide
aataccaaaccacacat

SEQ ID NO: 157 - DNA, 17 bp, Artificial sequence
  Synthetic oligonucleotide
gccagaaagatgaggaa

SEQ ID NO: 158 - DNA, 17 bp, Artificial sequence
  Synthetic oligonucleotide
cgctgtgagccggcgac

SEQ ID NO: 159 - DNA, 17 bp, Artificial sequence
  Synthetic oligonucleotide
ccgcctctctctttttt

SEQ ID NO: 160 - DNA, 17 bp, Artificial sequence
  Synthetic oligonucleotide
ctttcagagctggaaga

SEQ ID NO: 161 - DNA, 17 bp, Artificial sequence
  Synthetic oligonucleotide
cagaactaactgctcac

SEQ ID NO: 162 - DNA, 17 bp, Artificial sequence
  Synthetic oligonucleotide
aacatcacatgggctca

SEQ ID NO: 163 - DNA, 17 bp, Artificial sequence
  Synthetic oligonucleotide
tctgggttaatgcctga

SEQ ID NO: 164 - DNA, 17 bp, Artificial sequence
  Synthetic oligonucleotide
attgttctcagagacca

SEQ ID NO: 165 - DNA, 17 bp, Artificial sequence
  Synthetic oligonucleotide
acagtaaagatttgcat

SEQ ID NO: 166 - DNA, 17 bp, Artificial sequence
  Synthetic oligonucleotide
tgatgcctctacctcca

SEQ ID NO: 167 - DNA, 17 bp, Artificial sequence
  Synthetic oligonucleotide
ttgaaattttccagcta

SEQ ID NO: 168 - DNA, 17 bp, Artificial sequence
  Synthetic oligonucleotide
tatacctaatatgtttg

SEQ ID NO: 169 - DNA, 17 bp, Artificial sequence
  Synthetic oligonucleotide
atttcattaatctgtga

SEQ ID NO: 170 - DNA, 17 bp, Artificial sequence
  Synthetic oligonucleotide
cagactttctgtgtggt

SEQ ID NO: 171 - DNA, 17 bp, Artificial sequence
  Synthetic oligonucleotide
aatttggaagctaatgt

SEQ ID NO: 172 - DNA, 17 bp, Artificial sequence
  Synthetic oligonucleotide
agttcccatgagaccag

SEQ ID NO: 173 - DNA, 17 bp, Artificial sequence
  Synthetic oligonucleotide
tggcttggagcaaaagg

SEQ ID NO: 174 - DNA, 17 bp, Artificial sequence
  Synthetic oligonucleotide
ttatgcagtggaactaa

SEQ ID NO: 175 - DNA, 17 bp, Artificial sequence
  Synthetic oligonucleotide
catacaaacccaaagag

SEQ ID NO: 176 - DNA, 17 bp, Artificial sequence
  Synthetic oligonucleotide
gatgaagttaactccct

SEQ ID NO: 177 - DNA, 17 bp, Artificial sequence
  Synthetic oligonucleotide
tctcctatagagatgaa

SEQ ID NO: 178 - DNA, 17 bp, Artificial sequence
  Synthetic oligonucleotide
tctatccactctcctat

SEQ ID NO: 179 - DNA, 17 bp, Artificial sequence
  Synthetic oligonucleotide
tctgttaactgaggtag

SEQ ID NO: 180 - DNA, 17 bp, Artificial sequence
  Synthetic oligonucleotide
ggcttctggctgactga

SEQ ID NO: 181 - DNA, 17 bp, Artificial sequence
  Synthetic oligonucleotide
gaacattaaaatttgca

SEQ ID NO: 182 - DNA, 17 bp, Artificial sequence
  Synthetic oligonucleotide
tgggccccttctggtcg

SEQ ID NO: 183 - DNA, 17 bp, Artificial sequence
  Synthetic oligonucleotide
gaaaggcagaaggcttg

SEQ ID NO: 184 - DNA, 17 bp, Artificial sequence
  Synthetic oligonucleotide
ctttacaccacactgtc

SEQ ID NO: 185 - DNA, 17 bp, Artificial sequence
  Synthetic oligonucleotide
taatgaattcctttaca

SEQ ID NO: 186 - DNA, 17 bp, Artificial sequence
  Synthetic oligonucleotide
aatacatccatggctaa

SEQ ID NO: 187 - DNA, 17 bp, Artificial sequence
  Synthetic oligonucleotide
ttggcctttgaaagtcc

SEQ ID NO: 188 - DNA, 17 bp, Artificial sequence
  Synthetic oligonucleotide
gttttctcagcagcagc

SEQ ID NO: 189 - DNA, 17 bp, Artificial sequence
  Synthetic oligonucleotide
ggttttggagcctacat

SEQ ID NO: 190 - DNA, 17 bp, Artificial sequence
  Synthetic oligonucleotide
gcaccactccctccttg

SEQ ID NO: 191 - DNA, 17 bp, Artificial sequence
  Synthetic oligonucleotide
gttgccacaccatgcac

SEQ ID NO: 192 - DNA, 17 bp, Artificial sequence
  Synthetic oligonucleotide
acatttgtcacttgctc

SEQ ID NO: 193 - DNA, 17 bp, Artificial sequence
  Synthetic oligonucleotide
ccgtcaccactgctcct

SEQ ID NO: 194 - DNA, 17 bp, Artificial sequence
  Synthetic oligonucleotide
ctgtcacacccgtcacc

SEQ ID NO: 195 - DNA, 17 bp, Artificial sequence
  Synthetic oligonucleotide
ttgacaaagccagtggc

SEQ ID NO: 196 - DNA, 17 bp, Artificial sequence
  Synthetic oligonucleotide
ggatccacaggcatatc

SEQ ID NO: 197 - DNA, 17 bp, Artificial sequence
  Synthetic oligonucleotide
caaagatatttcttagg

SEQ ID NO: 198 - DNA, 17 bp, Artificial sequence
  Synthetic oligonucleotide
ctgggcacattggaact

SEQ ID NO: 199 - DNA, 17 bp, Artificial sequence
  Synthetic oligonucleotide
gacttcgagatacactg

SEQ ID NO: 200 - DNA, 17 bp, Artificial sequence
  Synthetic oligonucleotide
tcaatcactgctgatgg

SEQ ID NO: 201 - DNA, 17 bp, Artificial sequence
  Synthetic oligonucleotide
aaagaccctgctaccat

SEQ ID NO: 202 - DNA, 17 bp, Artificial sequence
  Synthetic oligonucleotide
cagcacacaaagaccct

SEQ ID NO: 203 - DNA, 17 bp, Artificial sequence
  Synthetic oligonucleotide
agccacaaaatccacag

SEQ ID NO: 204 - DNA, 17 bp, Artificial sequence
  Synthetic oligonucleotide
taggtgtttttaatttg

SEQ ID NO: 205 - DNA, 17 bp, Artificial sequence
  Synthetic oligonucleotide
atagtgaggatttagaa

SEQ ID NO: 206 - DNA, 17 bp, Artificial sequence
  Synthetic oligonucleotide
atcattaaaagacacct

SEQ ID NO: 207 - DNA, 17 bp, Artificial sequence
  Synthetic oligonucleotide
cgcaaaatggtaaaatt

SEQ ID NO: 208 - DNA, 17 bp, Artificial sequence
  Synthetic oligonucleotide
cgttttattttaattct

SEQ ID NO: 209 - DNA, 17 bp, Artificial sequence
  Synthetic oligonucleotide
cttataagcatgatttt

SEQ ID NO: 210 - DNA, 17 bp, Artificial sequence
  Synthetic oligonucleotide
cttcttcaaatggctat

SEQ ID NO: 211 - DNA, 17 bp, Artificial sequence
  Synthetic oligonucleotide
tggcagtgttgcttcag

SEQ ID NO: 212 - DNA, 17 bp, Artificial sequence
  Synthetic oligonucleotide
ctacaatagtagttggg

SEQ ID NO: 213 - DNA, 17 bp, Artificial sequence
  Synthetic oligonucleotide
tgttaataaaaggctca

SEQ ID NO: 214 - DNA, 17 bp, Artificial sequence
  Synthetic oligonucleotide
atttattgtcagaaagg

SEQ ID NO: 215 - DNA, 17 bp, Artificial sequence
  Synthetic oligonucleotide
gggaacccacttttttt

SEQ ID NO: 216 - DNA, 17 bp, Artificial sequence
  Synthetic oligonucleotide
ctaatgtgtcttatggc

SEQ ID NO: 217 - DNA, 17 bp, Artificial sequence
  Synthetic oligonucleotide
gtgaggaatgctgagtt

SEQ ID NO: 218 - DNA, 17 bp, Artificial sequence
  Synthetic oligonucleotide
tgatctcctttaaggtg

SEQ ID NO: 219 - DNA, 17 bp, Artificial sequence
  Synthetic oligonucleotide
ggaaaaatcctagaatt

SEQ ID NO: 220 - DNA, 17 bp, Artificial sequence
  Synthetic oligonucleotide
agagtttttcaccatca

SEQ ID NO: 221 - DNA, 17 bp, Artificial sequence
  Synthetic oligonucleotide
cttgaaattatactttc

SEQ ID NO: 222 - DNA, 17 bp, Artificial sequence
  Synthetic oligonucleotide
gcgcccaatatatatca

SEQ ID NO: 223 - DNA, 17 bp, Artificial sequence
  Synthetic oligonucleotide
tcttcaattaggtaaaa

SEQ ID NO: 224 - DNA, 17 bp, Artificial sequence
  Synthetic oligonucleotide
caagaaacttaccattt

SEQ ID NO: 225 - DNA, 17 bp, Artificial sequence
  Synthetic oligonucleotide
ctttctaaccttcctga

SEQ ID NO: 226 - DNA, 17 bp, Artificial sequence
  Synthetic oligonucleotide
cactgctatcagtctag

SEQ ID NO: 227 - DNA, 17 bp, Artificial sequence
  Synthetic oligonucleotide
gaatttgtatccacata

SEQ ID NO: 228 - DNA, 17 bp, Artificial sequence
  Synthetic oligonucleotide
tatataaagtaattcac

SEQ ID NO: 229 - DNA, 17 bp, Artificial sequence
  Synthetic oligonucleotide
atatgagacaagcttcc

SEQ ID NO: 230 - DNA, 17 bp, Artificial sequence
  Synthetic oligonucleotide
ctgcaaaataaacctag

SEQ ID NO: 231 - DNA, 17 bp, Artificial sequence
  Synthetic oligonucleotide
ctgaactgttttggtaa

SEQ ID NO: 232 - DNA, 17 bp, Artificial sequence
  Synthetic oligonucleotide
accccacttggaatacc

SEQ ID NO: 233 - DNA, 17 bp, Artificial sequence
  Synthetic oligonucleotide
atactggataagccaga

SEQ ID NO: 234 - DNA, 17 bp, Artificial sequence
  Synthetic oligonucleotide
ccttgcccaactggtcc

SEQ ID NO: 235 - DNA, 17 bp, Artificial sequence
  Synthetic oligonucleotide
ccagaggaggccgctgt

SEQ ID NO: 236 - DNA, 17 bp, Artificial sequence
  Synthetic oligonucleotide
ccgactcctccccgcct

SEQ ID NO: 237 - DNA, 17 bp, Artificial sequence
  Synthetic oligonucleotide
tctttccactctatcag

SEQ ID NO: 238 - DNA, 17 bp, Artificial sequence
  Synthetic oligonucleotide
actgcatatttagagtc

SEQ ID NO: 239 - DNA, 17 bp, Artificial sequence
  Synthetic oligonucleotide
acatgaaagccctcatt

SEQ ID NO: 240 - DNA, 17 bp, Artificial sequence
  Synthetic oligonucleotide
atgaattgccactataa

SEQ ID NO: 241 - DNA, 17 bp, Artificial sequence
  Synthetic oligonucleotide
tggataaaagaagttac

SEQ ID NO: 242 - DNA, 17 bp, Artificial sequence
  Synthetic oligonucleotide
tacttctctggacctct

SEQ ID NO: 243 - DNA, 17 bp, Artificial sequence
  Synthetic oligonucleotide
tttcatcaatatctgca

SEQ ID NO: 244 - DNA, 17 bp, Artificial sequence
  Synthetic oligonucleotide
aatttaaccttaaagta

SEQ ID NO: 245 - DNA, 17 bp, Artificial sequence
  Synthetic oligonucleotide
gtagaggcccaataagt

SEQ ID NO: 246 - DNA, 17 bp, Artificial sequence
  Synthetic oligonucleotide
agttattgctatcaaga

SEQ ID NO: 247 - DNA, 17 bp, Artificial sequence
  Synthetic oligonucleotide
gactctagaaaagctct

SEQ ID NO: 248 - DNA, 17 bp, Artificial sequence
  Synthetic oligonucleotide
ctttttcacttgtctca

SEQ ID NO: 249 - DNA, 17 bp, Artificial sequence
  Synthetic oligonucleotide
agagctgtttgaagtga

SEQ ID NO: 250 - DNA, 17 bp, Artificial sequence
  Synthetic oligonucleotide
acctatgttgaaactta

SEQ ID NO: 251 - DNA, 17 bp, Artificial sequence
  Synthetic oligonucleotide
gacatacaaacccaaag

SEQ ID NO: 252 - DNA, 17 bp, Artificial sequence
  Synthetic oligonucleotide
agagatgaagttaactc

SEQ ID NO: 253 - DNA, 17 bp, Artificial sequence
  Synthetic oligonucleotide
ctctcctatagagatga

SEQ ID NO: 254 - DNA, 17 bp, Artificial sequence
  Synthetic oligonucleotide
cccttttcaagagcttt

SEQ ID NO: 255 - DNA, 17 bp, Artificial sequence
  Synthetic oligonucleotide
taagctcatatttatag

SEQ ID NO: 256 - DNA, 17 bp, Artificial sequence
  Synthetic oligonucleotide
taaaagatcatgagggc

SEQ ID NO: 257 - DNA, 17 bp, Artificial sequence
  Synthetic oligonucleotide
gaaacatgagtttaata

SEQ ID NO: 258 - DNA, 17 bp, Artificial sequence
  Synthetic oligonucleotide
gccccctctcttgggcc

SEQ ID NO: 259 - DNA, 17 bp, Artificial sequence
  Synthetic oligonucleotide
tcacgagggtggaaagg

SEQ ID NO: 260 - DNA, 17 bp, Artificial sequence
  Synthetic oligonucleotide
tcctttacaccacactg

SEQ ID NO: 261 - DNA, 17 bp, Artificial sequence
  Synthetic oligonucleotide
tccatggctaatgaatt

SEQ ID NO: 262 - DNA, 17 bp, Artificial sequence
  Synthetic oligonucleotide
tgaatacatccatggct

SEQ ID NO: 263 - DNA, 17 bp, Artificial sequence
  Synthetic oligonucleotide
cttggcctttgaaagtc

SEQ ID NO: 264 - DNA, 17 bp, Artificial sequence
  Synthetic oligonucleotide
cacaccctgtttggttt

SEQ ID NO: 265 - DNA, 17 bp, Artificial sequence
  Synthetic oligonucleotide
ttggttttggagcctac

SEQ ID NO: 266 - DNA, 17 bp, Artificial sequence
  Synthetic oligonucleotide
accatgcaccactccct

SEQ ID NO: 267 - DNA, 17 bp, Artificial sequence
  Synthetic oligonucleotide
ctgttgccacaccatgc

SEQ ID NO: 268 - DNA, 17 bp, Artificial sequence
  Synthetic oligonucleotide
aacatttgtcacttgct

SEQ ID NO: 269 - DNA, 17 bp, Artificial sequence
  Synthetic oligonucleotide
cccgtcaccactgctcc

SEQ ID NO: 270 - DNA, 17 bp, Artificial sequence
  Synthetic oligonucleotide
tgctgtcacacccgtca

SEQ ID NO: 271 - DNA, 17 bp, Artificial sequence
  Synthetic oligonucleotide
actggtcctttttgaca

SEQ ID NO: 272 - DNA, 17 bp, Artificial sequence
  Synthetic oligonucleotide
cctcattgtcaggatcc

SEQ ID NO: 273 - DNA, 17 bp, Artificial sequence
  Synthetic oligonucleotide
gaaactgggagcaaaga

SEQ ID NO: 274 - DNA, 17 bp, Artificial sequence
  Synthetic oligonucleotide
aaatgtcatgactgggc

SEQ ID NO: 275 - DNA, 17 bp, Artificial sequence
  Synthetic oligonucleotide
agacttcgagatacact

SEQ ID NO: 276 - DNA, 17 bp, Artificial sequence
  Synthetic oligonucleotide
gtacagatacttcaatc

SEQ ID NO: 277 - DNA, 17 bp, Artificial sequence
  Synthetic oligonucleotide
caaagaccctgctacca

SEQ ID NO: 278 - DNA, 17 bp, Artificial sequence
  Synthetic oligonucleotide
cacagcacacaaagacc

SEQ ID NO: 279 - DNA, 17 bp, Artificial sequence
  Synthetic oligonucleotide
aagccacaaaatccaca

SEQ ID NO: 280 - DNA, 17 bp, Artificial sequence
  Synthetic oligonucleotide
cttaggtgtttttaatt

SEQ ID NO: 281 - DNA, 17 bp, Artificial sequence
  Synthetic oligonucleotide
ttctgaacaacagcaac

SEQ ID NO: 282 - DNA, 17 bp, Artificial sequence
  Synthetic oligonucleotide
tcttagacagtatcatt

SEQ ID NO: 283 - DNA, 17 bp, Artificial sequence
  Synthetic oligonucleotide
ataaaacacatcgcaaa

SEQ ID NO: 284 - DNA, 17 bp, Artificial sequence
  Synthetic oligonucleotide
tttgcaatgagataacg

SEQ ID NO: 285 - DNA, 17 bp, Artificial sequence
  Synthetic oligonucleotide
gcttataagcatgattt

SEQ ID NO: 286 - DNA, 17 bp, Artificial sequence
  Synthetic oligonucleotide
taaaattcctccttctt

SEQ ID NO: 287 - DNA, 17 bp, Artificial sequence
  Synthetic oligonucleotide
aaacacacttctggcag

SEQ ID NO: 288 - DNA, 17 bp, Artificial sequence
  Synthetic oligonucleotide
aatagaccactctacaa

SEQ ID NO: 289 - DNA, 17 bp, Artificial sequence
  Synthetic oligonucleotide
cgagacaaaaataacaa

SEQ ID NO: 290 - DNA, 17 bp, Artificial sequence
  Synthetic oligonucleotide
atattatttattgtcag

SEQ ID NO: 291 - DNA, 17 bp, Artificial sequence
  Synthetic oligonucleotide
gcttagttcccgggaac

SEQ ID NO: 292 - DNA, 17 bp, Artificial sequence
  Synthetic oligonucleotide
gctaatatgtgctaatg

SEQ ID NO: 293 - DNA, 17 bp, Artificial sequence
  Synthetic oligonucleotide
gaatttctgatgattaa

SEQ ID NO: 294 - DNA, 17 bp, Artificial sequence
  Synthetic oligonucleotide
gtctagagaattgatct

SEQ ID NO: 295 - DNA, 17 bp, Artificial sequence
  Synthetic oligonucleotide
acctttcctaaggaaaa

SEQ ID NO: 296 - DNA, 17 bp, Artificial sequence
  Synthetic oligonucleotide
attaatttatacagagt

SEQ ID NO: 297 - DNA, 17 bp, Artificial sequence
  Synthetic oligonucleotide
gaatattctgtcttgaa

SEQ ID NO: 298 - DNA, 17 bp, Artificial sequence
  Synthetic oligonucleotide
tccttcctcaccagcgc

SEQ ID NO: 299 - DNA, 17 bp, Artificial sequence
  Synthetic oligonucleotide
gtagtagtctctcttca

SEQ ID NO: 300 - DNA, 17 bp, Artificial sequence
  Synthetic oligonucleotide
cataacttaaataaaac

SEQ ID NO: 301 - DNA, 17 bp, Artificial sequence
  Synthetic oligonucleotide
cctaaccgccactttct

SEQ ID NO: 302 - DNA, 17 bp, Artificial sequence
  Synthetic oligonucleotide
ttgttctaggtcactgc

SEQ ID NO: 303 - DNA, 17 bp, Artificial sequence
  Synthetic oligonucleotide
cactttaaaggagaatt

SEQ ID NO: 304 - DNA, 17 bp, Artificial sequence
  Synthetic oligonucleotide
gtcccaaataaactatt

SEQ ID NO: 305 - DNA, 17 bp, Artificial sequence
  Synthetic oligonucleotide
ctcgggagtgaatatga

SEQ ID NO: 306 - DNA, 17 bp, Artificial sequence
  Synthetic oligonucleotide
agaatgtaagtctgcaa

SEQ ID NO: 307 - DNA, 17 bp, Artificial sequence
  Synthetic oligonucleotide
caaagtgcactctgaac

SEQ ID NO: 308 - DNA, 17 bp, Artificial sequence
  Synthetic oligonucleotide
ttctgaaaaagacccca

SEQ ID NO: 309 - DNA, 17 bp, Artificial sequence
  Synthetic oligonucleotide
caaatagctacatactg

SEQ ID NO: 310 - DNA, 17 bp, Artificial sequence
  Synthetic oligonucleotide
cggaggcggcacccggg

SEQ ID NO: 311 - DNA, 17 bp, Artificial sequence
  Synthetic oligonucleotide
tctccacaactccgact

SEQ ID NO: 312 - DNA, 17 bp, Artificial sequence
  Synthetic oligonucleotide
taatcagggaagtgatg

SEQ ID NO: 313 - DNA, 17 bp, Artificial sequence
  Synthetic oligonucleotide
cttcagaaaatctccag

SEQ ID NO: 314 - DNA, 17 bp, Artificial sequence
  Synthetic oligonucleotide
cacaactatgctgcaat

SEQ ID NO: 315 - DNA, 17 bp, Artificial sequence
  Synthetic oligonucleotide
atcatccagtagagtga

SEQ ID NO: 316 - DNA, 17 bp, Artificial sequence
  Synthetic oligonucleotide
gagaacacttaagtgaa

SEQ ID NO: 317 - DNA, 17 bp, Artificial sequence
  Synthetic oligonucleotide
atttccatgaagccaag

SEQ ID NO: 318 - DNA, 17 bp, Artificial sequence
  Synthetic oligonucleotide
ctagagaccacctgaga

SEQ ID NO: 319 - DNA, 17 bp, Artificial sequence
  Synthetic oligonucleotide
ctaatgaacagagaaag

SEQ ID NO: 320 - DNA, 17 bp, Artificial sequence
  Synthetic oligonucleotide
ccaaagtaagaggagat

SEQ ID NO: 321 - DNA, 17 bp, Artificial sequence
  Synthetic oligonucleotide
tgttgctaagcacaaac

SEQ ID NO: 322 - DNA, 17 bp, Artificial sequence
  Synthetic oligonucleotide
tcaaggtgccatatctg

SEQ ID NO: 323 - DNA, 17 bp, Artificial sequence
  Synthetic oligonucleotide
aaagaaaggcagtgttg

SEQ ID NO: 324 - DNA, 17 bp, Artificial sequence
  Synthetic oligonucleotide
ccaatatggattcagca

SEQ ID NO: 325 - DNA, 17 bp, Artificial sequence
  Synthetic oligonucleotide
caattattagcagttac

SEQ ID NO: 326 - DNA, 17 bp, Artificial sequence
  Synthetic oligonucleotide
ttgacatacaaacccaa

SEQ ID NO: 327 - DNA, 17 bp, Artificial sequence
  Synthetic oligonucleotide
atagagatgaagttaac

SEQ ID NO: 328 - DNA, 17 bp, Artificial sequence
  Synthetic oligonucleotide
cactctcctatagagat

SEQ ID NO: 329 - DNA, 17 bp, Artificial sequence
  Synthetic oligonucleotide
ttcccttttcaagagct

SEQ ID NO: 330 - DNA, 17 bp, Artificial sequence
  Synthetic oligonucleotide
agaaggaatgcacaata

SEQ ID NO: 331 - DNA, 17 bp, Artificial sequence
  Synthetic oligonucleotide
gccataattcaagtcag

SEQ ID NO: 332 - DNA, 17 bp, Artificial sequence
  Synthetic oligonucleotide
actgacaacttacagca

SEQ ID NO: 333 - DNA, 17 bp, Artificial sequence
  Synthetic oligonucleotide
ctcggtcgctcgccccc

SEQ ID NO: 334 - DNA, 17 bp, Artificial sequence
  Synthetic oligonucleotide
cagttctccgctcacga

SEQ ID NO: 335 - DNA, 17 bp, Artificial sequence
  Synthetic oligonucleotide
ttcctttacaccacact

SEQ ID NO: 336 - DNA, 17 bp, Artificial sequence
  Synthetic oligonucleotide
catccatggctaatgaa

SEQ ID NO: 337 - DNA, 17 bp, Artificial sequence
  Synthetic oligonucleotide
catgaatacatccatgg

SEQ ID NO: 338 - DNA, 17 bp, Artificial sequence
  Synthetic oligonucleotide
ccttggcctttgaaagt

SEQ ID NO: 339 - DNA, 17 bp, Artificial sequence
  Synthetic oligonucleotide
gctgcttctgccacacc

SEQ ID NO: 340 - DNA, 17 bp, Artificial sequence
  Synthetic oligonucleotide
cttggttttggagccta

SEQ ID NO: 341 - DNA, 17 bp, Artificial sequence
  Synthetic oligonucleotide
acaccatgcaccactcc

SEQ ID NO: 342 - DNA, 17 bp, Artificial sequence
  Synthetic oligonucleotide
ctcagccactgttgcca

SEQ ID NO: 343 - DNA, 17 bp, Artificial sequence
  Synthetic oligonucleotide
caacatttgtcacttgc

SEQ ID NO: 344 - DNA, 17 bp, Artificial sequence
  Synthetic oligonucleotide
cacccgtcaccactgct

SEQ ID NO: 345 - DNA, 17 bp, Artificial sequence
  Synthetic oligonucleotide
ttctgggctactgctgt

SEQ ID NO: 346 - DNA, 17 bp, Artificial sequence
  Synthetic oligonucleotide
attcttgcccaactggt

SEQ ID NO: 347 - DNA, 17 bp, Artificial sequence
  Synthetic oligonucleotide
catttcataagcctcat

SEQ ID NO: 348 - DNA, 17 bp, Artificial sequence
  Synthetic oligonucleotide
gcagatctcaagaaact

SEQ ID NO: 349 - DNA, 17 bp, Artificial sequence
  Synthetic oligonucleotide
ctgtaaaaactttgaga

SEQ ID NO: 350 - DNA, 17 bp, Artificial sequence
  Synthetic oligonucleotide
aagacttcgagatacac

SEQ ID NO: 351 - DNA, 17 bp, Artificial sequence
  Synthetic oligonucleotide
ccgaaatgctgagtggg

SEQ ID NO: 352 - DNA, 17 bp, Artificial sequence
  Synthetic oligonucleotide
acaaagaccctgctacc

SEQ ID NO: 353 - DNA, 17 bp, Artificial sequence
  Synthetic oligonucleotide
tccacagcacacaaaga

SEQ ID NO: 354 - DNA, 17 bp, Artificial sequence
  Synthetic oligonucleotide
tgaagccacaaaatcca

SEQ ID NO: 355 - DNA, 17 bp, Artificial sequence
  Synthetic oligonucleotide
cacttaggtgtttttaa

SEQ ID NO: 356 - DNA, 17 bp, Artificial sequence
  Synthetic oligonucleotide
tcactaacaacttctga

SEQ ID NO: 357 - DNA, 17 bp, Artificial sequence
  Synthetic oligonucleotide
acaaatttcacaatacg

SEQ ID NO: 358 - DNA, 17 bp, Artificial sequence
  Synthetic oligonucleotide
tacaaacacaagtgaat

SEQ ID NO: 359 - DNA, 17 bp, Artificial sequence
  Synthetic oligonucleotide
tgagatgggataaaaat

SEQ ID NO: 360 - DNA, 17 bp, Artificial sequence
  Synthetic oligonucleotide
aattcatgttgcttata

SEQ ID NO: 361 - DNA, 17 bp, Artificial sequence
  Synthetic oligonucleotide
tctctacctcttctaaa

SEQ ID NO: 362 - DNA, 17 bp, Artificial sequence
  Synthetic oligonucleotide
agtgcataccaaaacac

SEQ ID NO: 363 - DNA, 17 bp, Artificial sequence
  Synthetic oligonucleotide
gacaggattgaagggag

SEQ ID NO: 364 - DNA, 17 bp, Artificial sequence
  Synthetic oligonucleotide
aaaaattatttcgagac

SEQ ID NO: 365 - DNA, 17 bp, Artificial sequence
  Synthetic oligonucleotide
cgaatattatttattgt

SEQ ID NO: 366 - DNA, 17 bp, Artificial sequence
  Synthetic oligonucleotide
tcttctacactgcttag

SEQ ID NO: 367 - DNA, 17 bp, Artificial sequence
  Synthetic oligonucleotide
gccttgaatgtgctaat

SEQ ID NO: 368 - DNA, 17 bp, Artificial sequence
  Synthetic oligonucleotide
ggcatttcctgtaaaaa

SEQ ID NO: 369 - DNA, 17 bp, Artificial sequence
  Synthetic oligonucleotide
aatttttatcagtctag

SEQ ID NO: 370 - DNA, 17 bp, Artificial sequence
  Synthetic oligonucleotide
tcttccctgaaagagaa

SEQ ID NO: 371 - DNA, 17 bp, Artificial sequence
  Synthetic oligonucleotide
ccccagaataattaaaa

SEQ ID NO: 372 - DNA, 17 bp, Artificial sequence
  Synthetic oligonucleotide
tagcatgtctagaatat

SEQ ID NO: 373 - DNA, 17 bp, Artificial sequence
  Synthetic oligonucleotide
gtcactcattcctcctt

SEQ ID NO: 374 - DNA, 17 bp, Artificial sequence
  Synthetic oligonucleotide
cttagcactctgtagta

SEQ ID NO: 375 - DNA, 17 bp, Artificial sequence
  Synthetic oligonucleotide
ccttgcttaaacataac

SEQ ID NO: 376 - DNA, 17 bp, Artificial sequence
  Synthetic oligonucleotide
ctttaggtagatttaaa

SEQ ID NO: 377 - DNA, 17 bp, Artificial sequence
  Synthetic oligonucleotide
ctaatctcaaattgttc

SEQ ID NO: 378 - DNA, 17 bp, Artificial sequence
  Synthetic oligonucleotide
taagggaagaaacactt

SEQ ID NO: 379 - DNA, 17 bp, Artificial sequence
  Synthetic oligonucleotide
ttaagtgtttggtccca

SEQ ID NO: 380 - DNA, 17 bp, Artificial sequence
  Synthetic oligonucleotide
caggtgaatgtctcggg

SEQ ID NO: 381 - DNA, 17 bp, Artificial sequence
  Synthetic oligonucleotide
aataacttgggagaatg

SEQ ID NO: 382 - DNA, 17 bp, Artificial sequence
  Synthetic oligonucleotide
caattgtgtgccaaagt

SEQ ID NO: 383 - DNA, 17 bp, Artificial sequence
  Synthetic oligonucleotide
tagtgcagagattctga

SEQ ID NO: 384 - DNA, 17 bp, Artificial sequence
  Synthetic oligonucleotide
tatgtcacaaatagcta

SEQ ID NO: 385 - DNA, 17 bp, Artificial sequence
  Synthetic oligonucleotide
aacccgctaacctgtcg

SEQ ID NO: 386 - DNA, 17 bp, Artificial sequence
  Synthetic oligonucleotide
cacaggaagggcggagg

SEQ ID NO: 387 - DNA, 17 bp, Artificial sequence
  Synthetic oligonucleotide
gtccctctgcttctcca

SEQ ID NO: 388 - DNA, 17 bp, Artificial sequence
  Synthetic oligonucleotide
catacacacgcgaactt

SEQ ID NO: 389 - DNA, 17 bp, Artificial sequence
  Synthetic oligonucleotide
tcaattattcatatgtc

SEQ ID NO: 390 - DNA, 17 bp, Artificial sequence
  Synthetic oligonucleotide
ctgcacagtaaaatgta

SEQ ID NO: 391 - DNA, 17 bp, Artificial sequence
  Synthetic oligonucleotide
agtgtgagcaaacattc

SEQ ID NO: 392 - DNA, 17 bp, Artificial sequence
  Synthetic oligonucleotide
aattgaatacattgtct

SEQ ID NO: 393 - DNA, 17 bp, Artificial sequence
  Synthetic oligonucleotide
tcctaaagtattgcact

SEQ ID NO: 394 - DNA, 17 bp, Artificial sequence
  Synthetic oligonucleotide
cctggtcatgactctga

SEQ ID NO: 395 - DNA, 17 bp, Artificial sequence
  Synthetic oligonucleotide
gatcaaatgtatagaga

SEQ ID NO: 396 - DNA, 17 bp, Artificial sequence
  Synthetic oligonucleotide
agaggcagggctagaca

SEQ ID NO: 397 - DNA, 17 bp, Artificial sequence
  Synthetic oligonucleotide
tgccaaagtaagaggag

SEQ ID NO: 398 - DNA, 17 bp, Artificial sequence
  Synthetic oligonucleotide
atagaactctgtagtca

SEQ ID NO: 399 - DNA, 17 bp, Artificial sequence
  Synthetic oligonucleotide
caaatgaacttctcaag

SEQ ID NO: 400 - DNA, 17 bp, Artificial sequence
  Synthetic oligonucleotide
aaattacactgttgaat

SEQ ID NO: 401 - DNA, 17 bp, Artificial sequence
  Synthetic oligonucleotide
ggcaaagggctctggtg

SEQ ID NO: 402 - DNA, 17 bp, Artificial sequence
  Synthetic oligonucleotide
gtaagttgtgaccatgc

SEQ ID NO: 403 - DNA, 17 bp, Artificial sequence
  Synthetic oligonucleotide
acttgacatacaaaccc

SEQ ID NO: 404 - DNA, 17 bp, Artificial sequence
  Synthetic oligonucleotide
tatagagatgaagttaa

SEQ ID NO: 405 - DNA, 17 bp, Artificial sequence
  Synthetic oligonucleotide
ccactctcctatagaga

SEQ ID NO: 406 - DNA, 17 bp, Artificial sequence
  Synthetic oligonucleotide
atttcccttttcaagag

SEQ ID NO: 407 - DNA, 17 bp, Artificial sequence
  Synthetic oligonucleotide
taactccatttaattgt

SEQ ID NO: 408 - DNA, 17 bp, Artificial sequence
  Synthetic oligonucleotide
acagtacactatttgtt

SEQ ID NO: 409 - DNA, 17 bp, Artificial sequence
  Synthetic oligonucleotide
accaccccaaactacct

SEQ ID NO: 410 - DNA, 17 bp, Artificial sequence
  Synthetic oligonucleotide
cgcacctcacttccgcg

SEQ ID NO: 411 - DNA, 17 bp, Artificial sequence
  Synthetic oligonucleotide
atggccactcccagttc

SEQ ID NO: 412 - DNA, 17 bp, Artificial sequence
  Synthetic oligonucleotide
attcctttacaccacac

SEQ ID NO: 413 - DNA, 17 bp, Artificial sequence
  Synthetic oligonucleotide
acatccatggctaatga

SEQ ID NO: 414 - DNA, 17 bp, Artificial sequence
  Synthetic oligonucleotide
ctttcatgaatacatcc

SEQ ID NO: 415 - DNA, 17 bp, Artificial sequence
  Synthetic oligonucleotide
ctccttggcctttgaaa

SEQ ID NO: 416 - DNA, 17 bp, Artificial sequence
  Synthetic oligonucleotide
gagaacaccctcttttg

SEQ ID NO: 417 - DNA, 17 bp, Artificial sequence
  Synthetic oligonucleotide
ccttggttttggagcct

SEQ ID NO: 418 - DNA, 17 bp, Artificial sequence
  Synthetic oligonucleotide
ccacaccatgcaccact

SEQ ID NO: 419 - DNA, 17 bp, Artificial sequence
  Synthetic oligonucleotide
gctctttggtcttctca

SEQ ID NO: 420 - DNA, 17 bp, Artificial sequence
  Synthetic oligonucleotide
tccaacatttgtcactt

SEQ ID NO: 421 - DNA, 17 bp, Artificial sequence
  Synthetic oligonucleotide
cacacccgtcaccactg

SEQ ID NO: 422 - DNA, 17 bp, Artificial sequence
  Synthetic oligonucleotide
gctccctccactgtctt

SEQ ID NO: 423 - DNA, 17 bp, Artificial sequence
  Synthetic oligonucleotide
gctccttcttcattctt

SEQ ID NO: 424 - DNA, 17 bp, Artificial sequence
  Synthetic oligonucleotide
tcctcagaaggcatttc

SEQ ID NO: 425 - DNA, 17 bp, Artificial sequence
  Synthetic oligonucleotide
aacatctgtcagcagat

SEQ ID NO: 426 - DNA, 17 bp, Artificial sequence
  Synthetic oligonucleotide
tcgagatacactgtaaa

SEQ ID NO: 427 - DNA, 17 bp, Artificial sequence
  Synthetic oligonucleotide
ggaagacttcgagatac

SEQ ID NO: 428 - DNA, 17 bp, Artificial sequence
  Synthetic oligonucleotide
aaagggaagcaccgaaa

SEQ ID NO: 429 - DNA, 17 bp, Artificial sequence
  Synthetic oligonucleotide
acacaaagaccctgcta

SEQ ID NO: 430 - DNA, 17 bp, Artificial sequence
  Synthetic oligonucleotide
caaaatccacagcacac

SEQ ID NO: 431 - DNA, 17 bp, Artificial sequence
  Synthetic oligonucleotide
attgaagccacaaaatc

SEQ ID NO: 432 - DNA, 17 bp, Artificial sequence
  Synthetic oligonucleotide
agtcacttaggtgtttt

SEQ ID NO: 433 - DNA, 17 bp, Artificial sequence
  Synthetic oligonucleotide
atgatagcaaatcacta

SEQ ID NO: 434 - DNA, 17 bp, Artificial sequence
  Synthetic oligonucleotide
gctcacatatttttaag

SEQ ID NO: 435 - DNA, 17 bp, Artificial sequence
  Synthetic oligonucleotide
caccatttatatacaaa

SEQ ID NO: 436 - DNA, 17 bp, Artificial sequence
  Synthetic oligonucleotide
tattaaagtgagatggg

SEQ ID NO: 437 - DNA, 17 bp, Artificial sequence
  Synthetic oligonucleotide
tgtcagttcttaattca

SEQ ID NO: 438 - DNA, 17 bp, Artificial sequence
  Synthetic oligonucleotide
ggttaatgttccatttt

SEQ ID NO: 439 - DNA, 17 bp, Artificial sequence
  Synthetic oligonucleotide
cttaaggaaccagtgca

SEQ ID NO: 440 - DNA, 17 bp, Artificial sequence
  Synthetic oligonucleotide
cagttccccaaaatacg

SEQ ID NO: 441 - DNA, 17 bp, Artificial sequence
  Synthetic oligonucleotide
tcacaccaatatcagac

SEQ ID NO: 442 - DNA, 17 bp, Artificial sequence
  Synthetic oligonucleotide
gtcgaatattatttatt

SEQ ID NO: 443 - DNA, 17 bp, Artificial sequence
  Synthetic oligonucleotide
agtcaaaatcatcttct

SEQ ID NO: 444 - DNA, 17 bp, Artificial sequence
  Synthetic oligonucleotide
attctctcagagccttg

SEQ ID NO: 445 - DNA, 17 bp, Artificial sequence
  Synthetic oligonucleotide
cgatgtttaaaggcatt

SEQ ID NO: 446 - DNA, 17 bp, Artificial sequence
  Synthetic oligonucleotide
ggaggccatgaaatttt

SEQ ID NO: 447 - DNA, 17 bp, Artificial sequence
  Synthetic oligonucleotide
gagttaatagatcttcc

SEQ ID NO: 448 - DNA, 17 bp, Artificial sequence
  Synthetic oligonucleotide
aaatgactatgccccag

SEQ ID NO: 449 - DNA, 17 bp, Artificial sequence
  Synthetic oligonucleotide
atataaactgctagcat

SEQ ID NO: 450 - DNA, 17 bp, Artificial sequence
  Synthetic oligonucleotide
ccatccttatagtcact

SEQ ID NO: 451 - DNA, 17 bp, Artificial sequence
  Synthetic oligonucleotide
gacacatgcagcttagc

SEQ ID NO: 452 - DNA, 17 bp, Artificial sequence
  Synthetic oligonucleotide
acaaatcctttccttgc

SEQ ID NO: 453 - DNA, 17 bp, Artificial sequence
  Synthetic oligonucleotide
taataccaatactttta

SEQ ID NO: 454 - DNA, 17 bp, Artificial sequence
  Synthetic oligonucleotide
tcacaactttcctaatc

SEQ ID NO: 455 - DNA, 17 bp, Artificial sequence
  Synthetic oligonucleotide
cagataaatattaaggg

SEQ ID NO: 456 - DNA, 17 bp, Artificial sequence
  Synthetic oligonucleotide
acttaaagaactttttg

SEQ ID NO: 457 - DNA, 17 bp, Artificial sequence
  Synthetic oligonucleotide
aggccacttggcaggtg

SEQ ID NO: 458 - DNA, 17 bp, Artificial sequence
  Synthetic oligonucleotide
atatgaggctgaataac

SEQ ID NO: 459 - DNA, 17 bp, Artificial sequence
  Synthetic oligonucleotide
tgttctgttcccaattg

SEQ ID NO: 460 - DNA, 17 bp, Artificial sequence
  Synthetic oligonucleotide
gcatctcacactagtgc

SEQ ID NO: 461 - DNA, 17 bp, Artificial sequence
  Synthetic oligonucleotide
atttattatgtcacaaa

SEQ ID NO: 462 - DNA, 17 bp, Artificial sequence
  Synthetic oligonucleotide
agtgggaggcaaacccg

SEQ ID NO: 463 - DNA, 17 bp, Artificial sequence
  Synthetic oligonucleotide
gaaaaggagcgcacagg

SEQ ID NO: 464 - DNA, 17 bp, Artificial sequence
  Synthetic oligonucleotide
ctggatcacaccagaat

SEQ ID NO: 465 - DNA, 17 bp, Artificial sequence
  Synthetic oligonucleotide
ctatcaccattttcctt

SEQ ID NO: 466 - DNA, 17 bp, Artificial sequence
  Synthetic oligonucleotide
agccataagtgaaatta

SEQ ID NO: 467 - DNA, 17 bp, Artificial sequence
  Synthetic oligonucleotide
agttcgatttaaatgcc

SEQ ID NO: 468 - DNA, 17 bp, Artificial sequence
  Synthetic oligonucleotide
acagtgtgagcaaacat

SEQ ID NO: 469 - DNA, 17 bp, Artificial sequence
  Synthetic oligonucleotide
ccctctttgtgttatac

SEQ ID NO: 470 - DNA, 17 bp, Artificial sequence
  Synthetic oligonucleotide
gaaagtttttatggaga

SEQ ID NO: 471 - DNA, 17 bp, Artificial sequence
  Synthetic oligonucleotide
tgtattttggatgcttc

SEQ ID NO: 472 - DNA, 17 bp, Artificial sequence
  Synthetic oligonucleotide
gaagtgactatgtcttc

SEQ ID NO: 473 - DNA, 17 bp, Artificial sequence
  Synthetic oligonucleotide
gccaaatgaatgggcca

SEQ ID NO: 474 - DNA, 17 bp, Artificial sequence
  Synthetic oligonucleotide
atcaaaaggaacatcaa

SEQ ID NO: 475 - DNA, 17 bp, Artificial sequence
  Synthetic oligonucleotide
tattcttctcctccatg

SEQ ID NO: 476 - DNA, 17 bp, Artificial sequence
  Synthetic oligonucleotide
aatgttggcaagcttga

SEQ ID NO: 477 - DNA, 17 bp, Artificial sequence
  Synthetic oligonucleotide
actcacactgcctagct

SEQ ID NO: 478 - DNA, 17 bp, Artificial sequence
  Synthetic oligonucleotide
cctatatattcaagatg

SEQ ID NO: 479 - DNA, 17 bp, Artificial sequence
  Synthetic oligonucleotide
agaagctatcaagacat

SEQ ID NO: 480 - DNA, 17 bp, Artificial sequence
  Synthetic oligonucleotide
ccacttgacatacaaac

SEQ ID NO: 481 - DNA, 17 bp, Artificial sequence
  Synthetic oligonucleotide
ctatagagatgaagtta

SEQ ID NO: 482 - DNA, 17 bp, Artificial sequence
  Synthetic oligonucleotide
atccactctcctataga

SEQ ID NO: 483 - DNA, 17 bp, Artificial sequence
  Synthetic oligonucleotide
aataggagttcaatgaa

SEQ ID NO: 484 - DNA, 17 bp, Artificial sequence
  Synthetic oligonucleotide
gttagataattattgag

SEQ ID NO: 485 - DNA, 17 bp, Artificial sequence
  Synthetic oligonucleotide
cttcaaaccttttgacc

SEQ ID NO: 486 - DNA, 17 bp, Artificial sequence
  Synthetic oligonucleotide
cctatttatggtataat

SEQ ID NO: 487 - DNA, 17 bp, Artificial sequence
  Synthetic oligonucleotide
actacatagagaacacc

SEQ ID NO: 488 - DNA, 17 bp, Artificial sequence
  Synthetic oligonucleotide
tcttctcagccactaca

SEQ ID NO: 489 - DNA, 17 bp, Artificial sequence
  Synthetic oligonucleotide
ttgatacccttccttgc

SEQ ID NO: 490 - DNA, 17 bp, Artificial sequence
  Synthetic oligonucleotide
accacactgagtccctc

SEQ ID NO: 491 - DNA, 17 bp, Artificial sequence
  Synthetic oligonucleotide
caccacactgagtccct

SEQ ID NO: 492 - DNA, 17 bp, Artificial sequence
  Synthetic oligonucleotide
acaccacactgagtccc

SEQ ID NO: 493 - DNA, 17 bp, Artificial sequence
  Synthetic oligonucleotide
ttacaccacactgagtc

SEQ ID NO: 494 - DNA, 17 bp, Artificial sequence
  Synthetic oligonucleotide
tttacaccacactgagt

SEQ ID NO: 495 - DNA, 17 bp, Artificial sequence
  Synthetic oligonucleotide
ctttacaccacactgag

SEQ ID NO: 496 - DNA, 17 bp, Artificial sequence
  Synthetic oligonucleotide
tacaccacactctttca

SEQ ID NO: 497 - DNA, 17 bp, Artificial sequence
  Synthetic oligonucleotide
ccacactcacttccgcg

SEQ ID NO: 498 - DNA, 17 bp, Artificial sequence
  Synthetic oligonucleotide
aaacccgctaacctgtc

SEQ ID NO: 499 - DNA, 17 bp, Artificial sequence
  Synthetic oligonucleotide
ggcaaacccgctaacct

SEQ ID NO: 500 - DNA, 17 bp, Artificial sequence
  Synthetic oligonucleotide
ggaggcaaacccgctaa

SEQ ID NO: 501 - DNA, 17 bp, Artificial sequence
  Synthetic oligonucleotide
gtgggaggcaaacccgc

SEQ ID NO: 502 - DNA, 17 bp, Artificial sequence
  Synthetic oligonucleotide
ggagtgggaggcaaacc

SEQ ID NO: 503 - DNA, 17 bp, Artificial sequence
  Synthetic oligonucleotide
cggcgacgcgaggctgg

SEQ ID NO: 504 - DNA, 17 bp, Artificial sequence
  Synthetic oligonucleotide
agccggcgacgcgaggc

SEQ ID NO: 505 - DNA, 17 bp, Artificial sequence
  Synthetic oligonucleotide
gtgagccggcgacgcga

SEQ ID NO: 506 - DNA, 17 bp, Artificial sequence
  Synthetic oligonucleotide
gctgtgagccggcgacg

SEQ ID NO: 507 - DNA, 17 bp, Artificial sequence
  Synthetic oligonucleotide
gccgctgtgagccggcg

SEQ ID NO: 508 - DNA, 17 bp, Artificial sequence
  Synthetic oligonucleotide
aggaggccgctgtgagc

SEQ ID NO: 509 - DNA, 17 bp, Artificial sequence
  Synthetic oligonucleotide
cagaggaggccgctgtg

SEQ ID NO: 510 - DNA, 17 bp, Artificial sequence
  Synthetic oligonucleotide
ccccagaggaggccgct

SEQ ID NO: 511 - DNA, 17 bp, Artificial sequence
  Synthetic oligonucleotide
tgtccccagaggaggcc

SEQ ID NO: 512 - DNA, 17 bp, Artificial sequence
  Synthetic oligonucleotide
gactgtccccagaggag

SEQ ID NO: 513 - DNA, 17 bp, Artificial sequence
  Synthetic oligonucleotide
gcggaggcggcacccgg

SEQ ID NO: 514 - DNA, 17 bp, Artificial sequence
  Synthetic oligonucleotide
agggcggaggcggcacc

SEQ ID NO: 515 - DNA, 17 bp, Artificial sequence
  Synthetic oligonucleotide
ggaagggcggaggcggc

SEQ ID NO: 516 - DNA, 17 bp, Artificial sequence
  Synthetic oligonucleotide
acaggaagggcggaggc

SEQ ID NO: 517 - DNA, 17 bp, Artificial sequence
  Synthetic oligonucleotide
cgcacaggaagggcgga

SEQ ID NO: 518 - DNA, 17 bp, Artificial sequence
  Synthetic oligonucleotide
gagcgcacaggaagggc

SEQ ID NO: 519 - DNA, 17 bp, Artificial sequence
  Synthetic oligonucleotide
aaggagcgcacaggaag

SEQ ID NO: 520 - DNA, 17 bp, Artificial sequence
  Synthetic oligonucleotide
ggaaaaggagcgcacag

SEQ ID NO: 521 - DNA, 17 bp, Artificial sequence
  Synthetic oligonucleotide
gaaggaaaaggagcgca

SEQ ID NO: 522 - DNA, 17 bp, Artificial sequence
  Synthetic oligonucleotide
ataggaaagaagaagga

SEQ ID NO: 523 - DNA, 17 bp, Artificial sequence
  Synthetic oligonucleotide
tttaataggaaagaaga

SEQ ID NO: 524 - DNA, 17 bp, Artificial sequence
  Synthetic oligonucleotide
aatatttaataggaaag

SEQ ID NO: 525 - DNA, 17 bp, Artificial sequence
  Synthetic oligonucleotide
tcccaaataatatttaa

SEQ ID NO: 526 - DNA, 17 bp, Artificial sequence
  Synthetic oligonucleotide
aattcccaaataatatt

SEQ ID NO: 527 - DNA, 17 bp, Artificial sequence
  Synthetic oligonucleotide
aacaattcccaaataat

SEQ ID NO: 528 - DNA, 17 bp, Artificial sequence
  Synthetic oligonucleotide
tttaaacaattcccaaa

SEQ ID NO: 529 - DNA, 17 bp, Artificial sequence
  Synthetic oligonucleotide
aaatttaaacaattccc

SEQ ID NO: 530 - DNA, 17 bp, Artificial sequence
  Synthetic oligonucleotide
cccgcctctctcttttt

SEQ ID NO: 531 - DNA, 17 bp, Artificial sequence
  Synthetic oligonucleotide
ctccccgcctctctctt

SEQ ID NO: 532 - DNA, 17 bp, Artificial sequence
  Synthetic oligonucleotide
actcctccccgcctctc

SEQ ID NO: 533 - DNA, 17 bp, Artificial sequence
  Synthetic oligonucleotide
tccgactcctccccgcc

SEQ ID NO: 534 - DNA, 17 bp, Artificial sequence
  Synthetic oligonucleotide
aactccgactcctcccc

SEQ ID NO: 535 - DNA, 17 bp, Artificial sequence
  Synthetic oligonucleotide
cacaactccgactcctc

SEQ ID NO: 536 - DNA, 17 bp, Artificial sequence
  Synthetic oligonucleotide
ctccacaactccgactc

SEQ ID NO: 537 - DNA, 17 bp, Artificial sequence
  Synthetic oligonucleotide
cttctccacaactccga

SEQ ID NO: 538 - DNA, 17 bp, Artificial sequence
  Synthetic oligonucleotide
ctgcttctccacaactc

SEQ ID NO: 539 - DNA, 17 bp, Artificial sequence
  Synthetic oligonucleotide
cctctgcttctccacaa

SEQ ID NO: 540 - DNA, 17 bp, Artificial sequence
  Synthetic oligonucleotide
agtccctctgcttctcc

SEQ ID NO: 541 - DNA, 17 bp, Artificial sequence
  Synthetic oligonucleotide
ctgagtccctctgcttc

SEQ ID NO: 542 - DNA, 17 bp, Artificial sequence
  Synthetic oligonucleotide
ctagtcctcctccttct

SEQ ID NO: 543 - DNA, 17 bp, Artificial sequence
  Synthetic oligonucleotide
cgtcctcctcctcctag

SEQ ID NO: 544 - DNA, 17 bp, Artificial sequence
  Synthetic oligonucleotide
gtcgccgtcctcctcct

SEQ ID NO: 545 - DNA, 17 bp, Artificial sequence
  Synthetic oligonucleotide
ttgggccccttctggtc

SEQ ID NO: 546 - DNA, 17 bp, Artificial sequence
  Synthetic oligonucleotide
ctcttgggccccttctg

SEQ ID NO: 547 - DNA, 17 bp, Artificial sequence
  Synthetic oligonucleotide
cctctcttgggcccctt

SEQ ID NO: 548 - DNA, 17 bp, Artificial sequence
  Synthetic oligonucleotide
ccccctctcttgggccc

SEQ ID NO: 549 - DNA, 17 bp, Artificial sequence
  Synthetic oligonucleotide
tcgccccctctcttggg

SEQ ID NO: 550 - DNA, 17 bp, Artificial sequence
  Synthetic oligonucleotide
cgctcgccccctctctt

SEQ ID NO: 551 - DNA, 17 bp, Artificial sequence
  Synthetic oligonucleotide
ggtcgctcgccccctct

SEQ ID NO: 552 - DNA, 17 bp, Artificial sequence
  Synthetic oligonucleotide
gctcggtcgctcgcccc

SEQ ID NO: 553 - DNA, 17 bp, Artificial sequence
  Synthetic oligonucleotide
acgcacctcacttccgc

SEQ ID NO: 554 - DNA, 17 bp, Artificial sequence
  Synthetic oligonucleotide
cgcacgcacctcacttc

SEQ ID NO: 555 - DNA, 17 bp, Artificial sequence
  Synthetic oligonucleotide
gcccgcacgcacctcac

SEQ ID NO: 556 - DNA, 17 bp, Artificial sequence
  Synthetic oligonucleotide
gcagcccgcacgcacct

SEQ ID NO: 557 - DNA, 17 bp, Artificial sequence
  Synthetic oligonucleotide
gctgcagcccgcacgca

SEQ ID NO: 558 - DNA, 17 bp, Artificial sequence
  Synthetic oligonucleotide
tgcgctgcagcccgcac

SEQ ID NO: 559 - DNA, 17 bp, Artificial sequence
  Synthetic oligonucleotide
gtctgcgctgcagcccg

SEQ ID NO: 560 - DNA, 17 bp, Artificial sequence
  Synthetic oligonucleotide
aggcttgaaggcaaggc

SEQ ID NO: 561 - DNA, 17 bp, Artificial sequence
  Synthetic oligonucleotide
agaaggcttgaaggcaa

SEQ ID NO: 562 - DNA, 17 bp, Artificial sequence
  Synthetic oligonucleotide
ggcagaaggcttgaagg

SEQ ID NO: 563 - DNA, 17 bp, Artificial sequence
  Synthetic oligonucleotide
aaaggcagaaggcttga

SEQ ID NO: 564 - DNA, 17 bp, Artificial sequence
  Synthetic oligonucleotide
tggaaaggcagaaggct

SEQ ID NO: 565 - DNA, 17 bp, Artificial sequence
  Synthetic oligonucleotide
gggtggaaaggcagaag

SEQ ID NO: 566 - DNA, 17 bp, Artificial sequence
  Synthetic oligonucleotide
cgagggtggaaaggcag

SEQ ID NO: 567 - DNA, 17 bp, Artificial sequence
  Synthetic oligonucleotide
ctcacgagggtggaaag

SEQ ID NO: 568 - DNA, 17 bp, Artificial sequence
  Synthetic oligonucleotide
ccgctcacgagggtgga

SEQ ID NO: 569 - DNA, 17 bp, Artificial sequence
  Synthetic oligonucleotide
tctccgctcacgagggt

SEQ ID NO: 570 - DNA, 17 bp, Artificial sequence
  Synthetic oligonucleotide
agttctccgctcacgag

SEQ ID NO: 571 - DNA, 17 bp, Artificial sequence
  Synthetic oligonucleotide
cccagttctccgctcac

SEQ ID NO: 572 - DNA, 17 bp, Artificial sequence
  Synthetic oligonucleotide
actcccagttctccgct

SEQ ID NO: 573 - DNA, 17 bp, Artificial sequence
  Synthetic oligonucleotide
gccactcccagttctcc

SEQ ID NO: 574 - DNA, 17 bp, Artificial sequence
  Synthetic oligonucleotide
aatggccactcccagtt

SEQ ID NO: 575 - DNA, 17 bp, Artificial sequence
  Synthetic oligonucleotide
tcgaatggccactccca

SEQ ID NO: 576 - DNA, 17 bp, Artificial sequence
  Synthetic oligonucleotide
cctttacaccacactgt

SEQ ID NO: 577 - DNA, 17 bp, Artificial sequence
  Synthetic oligonucleotide
aattcctttacaccaca

SEQ ID NO: 578 - DNA, 17 bp, Artificial sequence
  Synthetic oligonucleotide
tgaattcctttacacca

SEQ ID NO: 579 - DNA, 17 bp, Artificial sequence
  Synthetic oligonucleotide
aatgaattcctttacac

SEQ ID NO: 580 - DNA, 17 bp, Artificial sequence
  Synthetic oligonucleotide
ctaatgaattcctttac

SEQ ID NO: 581 - DNA, 17 bp, Artificial sequence
  Synthetic oligonucleotide
gctaatgaattccttta

SEQ ID NO: 582 - DNA, 17 bp, Artificial sequence
  Synthetic oligonucleotide
atggctaatgaattcct

SEQ ID NO: 583 - DNA, 17 bp, Artificial sequence
  Synthetic oligonucleotide
atccatggctaatgaat

SEQ ID NO: 584 - DNA, 17 bp, Artificial sequence
  Synthetic oligonucleotide
gaatacatccatggcta

SEQ ID NO: 585 - DNA, 17 bp, Artificial sequence
  Synthetic oligonucleotide
atgaatacatccatggc

SEQ ID NO: 586 - DNA, 17 bp, Artificial sequence
  Synthetic oligonucleotide
tcatgaatacatccatg

SEQ ID NO: 587 - DNA, 17 bp, Artificial sequence
  Synthetic oligonucleotide
tttcatgaatacatcca

SEQ ID NO: 588 - DNA, 17 bp, Artificial sequence
  Synthetic oligonucleotide
cctttcatgaatacatc

SEQ ID NO: 589 - DNA, 17 bp, Artificial sequence
  Synthetic oligonucleotide
tcctttcatgaatacat

SEQ ID NO: 590 - DNA, 17 bp, Artificial sequence
  Synthetic oligonucleotide
gtcctttcatgaataca

SEQ ID NO: 591 - DNA, 17 bp, Artificial sequence
  Synthetic oligonucleotide
agtcctttcatgaatac

SEQ ID NO: 592 - DNA, 17 bp, Artificial sequence
  Synthetic oligonucleotide
aagtcctttcatgaata

SEQ ID NO: 593 - DNA, 17 bp, Artificial sequence
  Synthetic oligonucleotide
gaaagtcctttcatgaa

SEQ ID NO: 594 - DNA, 17 bp, Artificial sequence
  Synthetic oligonucleotide
ttgaaagtcctttcatg

SEQ ID NO: 595 - DNA, 17 bp, Artificial sequence
  Synthetic oligonucleotide
tttgaaagtcctttcat

SEQ ID NO: 596 - DNA, 17 bp, Artificial sequence
  Synthetic oligonucleotide
ctttgaaagtcctttca

SEQ ID NO: 597 - DNA, 17 bp, Artificial sequence
  Synthetic oligonucleotide
gcctttgaaagtccttt

SEQ ID NO: 598 - DNA, 17 bp, Artificial sequence
  Synthetic oligonucleotide
tggcctttgaaagtcct

SEQ ID NO: 599 - DNA, 17 bp, Artificial sequence
  Synthetic oligonucleotide
tccttggcctttgaaag

SEQ ID NO: 600 - DNA, 17 bp, Artificial sequence
  Synthetic oligonucleotide
cagcagccacaactccc

SEQ ID NO: 601 - DNA, 17 bp, Artificial sequence
  Synthetic oligonucleotide
agcagcagccacaactc

SEQ ID NO: 602 - DNA, 17 bp, Artificial sequence
  Synthetic oligonucleotide
cagcagcagccacaact

SEQ ID NO: 603 - DNA, 17 bp, Artificial sequence
  Synthetic oligonucleotide
tctcagcagcagccaca

SEQ ID NO: 604 - DNA, 17 bp, Artificial sequence
  Synthetic oligonucleotide
ttctcagcagcagccac

SEQ ID NO: 605 - DNA, 17 bp, Artificial sequence
  Synthetic oligonucleotide
ttttctcagcagcagcc

SEQ ID NO: 606 - DNA, 17 bp, Artificial sequence
  Synthetic oligonucleotide
ggttttctcagcagcag

SEQ ID NO: 607 - DNA, 17 bp, Artificial sequence
  Synthetic oligonucleotide
tggttttctcagcagca

SEQ ID NO: 608 - DNA, 17 bp, Artificial sequence
  Synthetic oligonucleotide
gtttggttttctcagca

SEQ ID NO: 609 - DNA, 17 bp, Artificial sequence
  Synthetic oligonucleotide
ccacaccctgtttggtt

SEQ ID NO: 610 - DNA, 17 bp, Artificial sequence
  Synthetic oligonucleotide
ctgccacaccctgtttg

SEQ ID NO: 611 - DNA, 17 bp, Artificial sequence
  Synthetic oligonucleotide
cttctgccacaccctgt

SEQ ID NO: 612 - DNA, 17 bp, Artificial sequence
  Synthetic oligonucleotide
gcttctgccacaccctg

SEQ ID NO: 613 - DNA, 17 bp, Artificial sequence
  Synthetic oligonucleotide
ctgcttctgccacaccc

SEQ ID NO: 614 - DNA, 17 bp, Artificial sequence
  Synthetic oligonucleotide
ctgctgcttctgccaca

SEQ ID NO: 615 - DNA, 17 bp, Artificial sequence
  Synthetic oligonucleotide
cctgctgcttctgccac

SEQ ID NO: 616 - DNA, 17 bp, Artificial sequence
  Synthetic oligonucleotide
tttcctgctgcttctgc

SEQ ID NO: 617 - DNA, 17 bp, Artificial sequence
  Synthetic oligonucleotide
gtctttcctgctgcttc

SEQ ID NO: 618 - DNA, 17 bp, Artificial sequence
  Synthetic oligonucleotide
tttgtctttcctgctgc

SEQ ID NO: 619 - DNA, 17 bp, Artificial sequence
  Synthetic oligonucleotide
agagaacaccctctttt

SEQ ID NO: 620 - DNA, 17 bp, Artificial sequence
  Synthetic oligonucleotide
catagagaacaccctct

SEQ ID NO: 621 - DNA, 17 bp, Artificial sequence
  Synthetic oligonucleotide
ctacatagagaacaccc

SEQ ID NO: 622 - DNA, 17 bp, Artificial sequence
  Synthetic oligonucleotide
cctacatagagaacacc

SEQ ID NO: 623 - DNA, 17 bp, Artificial sequence
  Synthetic oligonucleotide
agcctacatagagaaca

SEQ ID NO: 624 - DNA, 17 bp, Artificial sequence
  Synthetic oligonucleotide
ggagcctacatagagaa

SEQ ID NO: 625 - DNA, 17 bp, Artificial sequence
  Synthetic oligonucleotide
tggagcctacatagaga

SEQ ID NO: 626 - DNA, 17 bp, Artificial sequence
  Synthetic oligonucleotide
ttggagcctacatagag

SEQ ID NO: 627 - DNA, 17 bp, Artificial sequence
  Synthetic oligonucleotide
gttttggagcctacata

SEQ ID NO: 628 - DNA, 17 bp, Artificial sequence
  Synthetic oligonucleotide
tggttttggagcctaca

SEQ ID NO: 629 - DNA, 17 bp, Artificial sequence
  Synthetic oligonucleotide
tccttggttttggagcc

SEQ ID NO: 630 - DNA, 17 bp, Artificial sequence
  Synthetic oligonucleotide
cctccttggttttggag

SEQ ID NO: 631 - DNA, 17 bp, Artificial sequence
  Synthetic oligonucleotide
tccctccttggttttgg

SEQ ID NO: 632 - DNA, 17 bp, Artificial sequence
  Synthetic oligonucleotide
cactccctccttggttt

SEQ ID NO: 633 - DNA, 17 bp, Artificial sequence
  Synthetic oligonucleotide
tgcaccactccctcctt

SEQ ID NO: 634 - DNA, 17 bp, Artificial sequence
  Synthetic oligonucleotide
ccatgcaccactccctc

SEQ ID NO: 635 - DNA, 17 bp, Artificial sequence
  Synthetic oligonucleotide
caccatgcaccactccc

SEQ ID NO: 636 - DNA, 17 bp, Artificial sequence
  Synthetic oligonucleotide
cacaccatgcaccactc

SEQ ID NO: 637 - DNA, 17 bp, Artificial sequence
  Synthetic oligonucleotide
ttgccacaccatgcacc

SEQ ID NO: 638 - DNA, 17 bp, Artificial sequence
  Synthetic oligonucleotide
tgttgccacaccatgca

SEQ ID NO: 639 - DNA, 17 bp, Artificial sequence
  Synthetic oligonucleotide
actgttgccacaccatg

SEQ ID NO: 640 - DNA, 17 bp, Artificial sequence
  Synthetic oligonucleotide
tctcagccactgttgcc

SEQ ID NO: 641 - DNA, 17 bp, Artificial sequence
  Synthetic oligonucleotide
cttctcagccactgttg

SEQ ID NO: 642 - DNA, 17 bp, Artificial sequence
  Synthetic oligonucleotide
tcttctcagccactgtt

SEQ ID NO: 643 - DNA, 17 bp, Artificial sequence
  Synthetic oligonucleotide
tttggtcttctcagcca

SEQ ID NO: 644 - DNA, 17 bp, Artificial sequence
  Synthetic oligonucleotide
tgctctttggtcttctc

SEQ ID NO: 645 - DNA, 17 bp, Artificial sequence
  Synthetic oligonucleotide
acttgctctttggtctt

SEQ ID NO: 646 - DNA, 17 bp, Artificial sequence
  Synthetic oligonucleotide
tcacttgctctttggtc

SEQ ID NO: 647 - DNA, 17 bp, Artificial sequence
  Synthetic oligonucleotide
gtcacttgctctttggt

SEQ ID NO: 648 - DNA, 17 bp, Artificial sequence
  Synthetic oligonucleotide
tgtcacttgctctttgg

SEQ ID NO: 649 - DNA, 17 bp, Artificial sequence
  Synthetic oligonucleotide
tttgtcacttgctcttt

SEQ ID NO: 650 - DNA, 17 bp, Artificial sequence
  Synthetic oligonucleotide
catttgtcacttgctct

SEQ ID NO: 651 - DNA, 17 bp, Artificial sequence
  Synthetic oligonucleotide
ccaacatttgtcacttg

SEQ ID NO: 652 - DNA, 17 bp, Artificial sequence
  Synthetic oligonucleotide
ctccaacatttgtcact

SEQ ID NO: 653 - DNA, 17 bp, Artificial sequence
  Synthetic oligonucleotide
tcctccaacatttgtca

SEQ ID NO: 654 - DNA, 17 bp, Artificial sequence
  Synthetic oligonucleotide
tgctcctccaacatttg

SEQ ID NO: 655 - DNA, 17 bp, Artificial sequence
  Synthetic oligonucleotide
cactgctcctccaacat

SEQ ID NO: 656 - DNA, 17 bp, Artificial sequence
  Synthetic oligonucleotide
caccactgctcctccaa

SEQ ID NO: 657 - DNA, 17 bp, Artificial sequence
  Synthetic oligonucleotide
cgtcaccactgctcctc

SEQ ID NO: 658 - DNA, 17 bp, Artificial sequence
  Synthetic oligonucleotide
acccgtcaccactgctc

SEQ ID NO: 659 - DNA, 17 bp, Artificial sequence
  Synthetic oligonucleotide
acacccgtcaccactgc

SEQ ID NO: 660 - DNA, 17 bp, Artificial sequence
  Synthetic oligonucleotide
tgtcacacccgtcacca

SEQ ID NO: 661 - DNA, 17 bp, Artificial sequence
  Synthetic oligonucleotide
gctgtcacacccgtcac

SEQ ID NO: 662 - DNA, 17 bp, Artificial sequence
  Synthetic oligonucleotide
ctgctgtcacacccgtc

SEQ ID NO: 663 - DNA, 17 bp, Artificial sequence
  Synthetic oligonucleotide
ctactgctgtcacaccc

SEQ ID NO: 664 - DNA, 17 bp, Artificial sequence
  Synthetic oligonucleotide
gggctactgctgtcaca

SEQ ID NO: 665 - DNA, 17 bp, Artificial sequence
  Synthetic oligonucleotide
tctgggctactgctgtc

SEQ ID NO: 666 - DNA, 17 bp, Artificial sequence
  Synthetic oligonucleotide
tcttctgggctactgct

SEQ ID NO: 667 - DNA, 17 bp, Artificial sequence
  Synthetic oligonucleotide
ctgtcttctgggctact

SEQ ID NO: 668 - DNA, 17 bp, Artificial sequence
  Synthetic oligonucleotide
ccactgtcttctgggct

SEQ ID NO: 669 - DNA, 17 bp, Artificial sequence
  Synthetic oligonucleotide
ccctccactgtcttctg

SEQ ID NO: 670 - DNA, 17 bp, Artificial sequence
  Synthetic oligonucleotide
tgctccctccactgtct

SEQ ID NO: 671 - DNA, 17 bp, Artificial sequence
  Synthetic oligonucleotide
atgctccctgctccctc

SEQ ID NO: 672 - DNA, 17 bp, Artificial sequence
  Synthetic oligonucleotide
gcaatgctccctgctcc

SEQ ID NO: 673 - DNA, 17 bp, Artificial sequence
  Synthetic oligonucleotide
gccagtggctgctgcaa

SEQ ID NO: 674 - DNA, 17 bp, Artificial sequence
  Synthetic oligonucleotide
aaagccagtggctgctg

SEQ ID NO: 675 - DNA, 17 bp, Artificial sequence
  Synthetic oligonucleotide
gacaaagccagtggctg

SEQ ID NO: 676 - DNA, 17 bp, Artificial sequence
  Synthetic oligonucleotide
tttgacaaagccagtgg

SEQ ID NO: 677 - DNA, 17 bp, Artificial sequence
  Synthetic oligonucleotide
ctttttgacaaagccag

SEQ ID NO: 678 - DNA, 17 bp, Artificial sequence
  Synthetic oligonucleotide
gtcctttttgacaaagc

SEQ ID NO: 679 - DNA, 17 bp, Artificial sequence
  Synthetic oligonucleotide
ctggtcctttttgacaa

SEQ ID NO: 680 - DNA, 17 bp, Artificial sequence
  Synthetic oligonucleotide
caactggtcctttttga

SEQ ID NO: 681 - DNA, 17 bp, Artificial sequence
  Synthetic oligonucleotide
gcccaactggtcctttt

SEQ ID NO: 682 - DNA, 17 bp, Artificial sequence
  Synthetic oligonucleotide
cttgcccaactggtcct

SEQ ID NO: 683 - DNA, 17 bp, Artificial sequence
  Synthetic oligonucleotide
cattcttgcccaactgg

SEQ ID NO: 684 - DNA, 17 bp, Artificial sequence
  Synthetic oligonucleotide
cttcattcttgcccaac

SEQ ID NO: 685 - DNA, 17 bp, Artificial sequence
  Synthetic oligonucleotide
cttcttcattcttgccc

SEQ ID NO: 686 - DNA, 17 bp, Artificial sequence
  Synthetic oligonucleotide
ctccttcttcattcttg

SEQ ID NO: 687 - DNA, 17 bp, Artificial sequence
  Synthetic oligonucleotide
gggctccttcttcattc

SEQ ID NO: 688 - DNA, 17 bp, Artificial sequence
  Synthetic oligonucleotide
agaattccttcctgtgg

SEQ ID NO: 689 - DNA, 17 bp, Artificial sequence
  Synthetic oligonucleotide
tccagaattccttcctg

SEQ ID NO: 690 - DNA, 17 bp, Artificial sequence
  Synthetic oligonucleotide
tcttccagaattccttc

SEQ ID NO: 691 - DNA, 17 bp, Artificial sequence
  Synthetic oligonucleotide
atatcttccagaattcc

SEQ ID NO: 692 - DNA, 17 bp, Artificial sequence
  Synthetic oligonucleotide
ggcatatcttccagaat

SEQ ID NO: 693 - DNA, 17 bp, Artificial sequence
  Synthetic oligonucleotide
acaggcatatcttccag

SEQ ID NO: 694 - DNA, 17 bp, Artificial sequence
  Synthetic oligonucleotide
tccacaggcatatcttc

SEQ ID NO: 695 - DNA, 17 bp, Artificial sequence
  Synthetic oligonucleotide
aggatccacaggcatat

SEQ ID NO: 696 - DNA, 17 bp, Artificial sequence
  Synthetic oligonucleotide
gtcaggatccacaggca

SEQ ID NO: 697 - DNA, 17 bp, Artificial sequence
  Synthetic oligonucleotide
attgtcaggatccacag

SEQ ID NO: 698 - DNA, 17 bp, Artificial sequence
  Synthetic oligonucleotide
ctcattgtcaggatcca

SEQ ID NO: 699 - DNA, 17 bp, Artificial sequence
  Synthetic oligonucleotide
agcctcattgtcaggat

SEQ ID NO: 700 - DNA, 17 bp, Artificial sequence
  Synthetic oligonucleotide
ataagcctcattgtcag

SEQ ID NO: 701 - DNA, 17 bp, Artificial sequence
  Synthetic oligonucleotide
ttcataagcctcattgt

SEQ ID NO: 702 - DNA, 17 bp, Artificial sequence
  Synthetic oligonucleotide
atttcataagcctcatt

SEQ ID NO: 703 - DNA, 17 bp, Artificial sequence
  Synthetic oligonucleotide
gcatttcataagcctca

SEQ ID NO: 704 - DNA, 17 bp, Artificial sequence
  Synthetic oligonucleotide
aaggcatttcataagcc

SEQ ID NO: 705 - DNA, 17 bp, Artificial sequence
  Synthetic oligonucleotide
cagaaggcatttcataa

SEQ ID NO: 706 - DNA, 17 bp, Artificial sequence
  Synthetic oligonucleotide
cctcagaaggcatttca

SEQ ID NO: 707 - DNA, 17 bp, Artificial sequence
  Synthetic oligonucleotide
cttcctcagaaggcatt

SEQ ID NO: 708 - DNA, 17 bp, Artificial sequence
  Synthetic oligonucleotide
acccttcctcagaaggc

SEQ ID NO: 709 - DNA, 17 bp, Artificial sequence
  Synthetic oligonucleotide
gatacccttcctcagaa

SEQ ID NO: 710 - DNA, 17 bp, Artificial sequence
  Synthetic oligonucleotide
tcttgatacccttcctc

SEQ ID NO: 711 - DNA, 17 bp, Artificial sequence
  Synthetic oligonucleotide
tagtcttgatacccttc

SEQ ID NO: 712 - DNA, 17 bp, Artificial sequence
  Synthetic oligonucleotide
tcttaggcttcaggttc

SEQ ID NO: 713 - DNA, 17 bp, Artificial sequence
  Synthetic oligonucleotide
atttcttaggcttcagg

SEQ ID NO: 714 - DNA, 17 bp, Artificial sequence
  Synthetic oligonucleotide
gatatttcttaggcttc

SEQ ID NO: 715 - DNA, 17 bp, Artificial sequence
  Synthetic oligonucleotide
aaagatatttcttaggc

SEQ ID NO: 716 - DNA, 17 bp, Artificial sequence
  Synthetic oligonucleotide
agcaaagatatttctta

SEQ ID NO: 717 - DNA, 17 bp, Artificial sequence
  Synthetic oligonucleotide
gggagcaaagatatttc

SEQ ID NO: 718 - DNA, 17 bp, Artificial sequence
  Synthetic oligonucleotide
actgggagcaaagatat

SEQ ID NO: 719 - DNA, 17 bp, Artificial sequence
  Synthetic oligonucleotide
agaaactgggagcaaag

SEQ ID NO: 720 - DNA, 17 bp, Artificial sequence
  Synthetic oligonucleotide
tcaagaaactgggagca

SEQ ID NO: 721 - DNA, 17 bp, Artificial sequence
  Synthetic oligonucleotide
atctcaagaaactggga

SEQ ID NO: 722 - DNA, 17 bp, Artificial sequence
  Synthetic oligonucleotide
cagatctcaagaaactg

SEQ ID NO: 723 - DNA, 17 bp, Artificial sequence
  Synthetic oligonucleotide
cagcagatctcaagaaa

SEQ ID NO: 724 - DNA, 17 bp, Artificial sequence
  Synthetic oligonucleotide
tgtcagcagatctcaag

SEQ ID NO: 725 - DNA, 17 bp, Artificial sequence
  Synthetic oligonucleotide
atctgtcagcagatctc

SEQ ID NO: 726 - DNA, 17 bp, Artificial sequence
  Synthetic oligonucleotide
gaacatctgtcagcaga

SEQ ID NO: 727 - DNA, 17 bp, Artificial sequence
  Synthetic oligonucleotide
atggaacatctgtcagc

SEQ ID NO: 728 - DNA, 17 bp, Artificial sequence
  Synthetic oligonucleotide
aggatggaacatctgtc

SEQ ID NO: 729 - DNA, 17 bp, Artificial sequence
  Synthetic oligonucleotide
tacaggatggaacatct

SEQ ID NO: 730 - DNA, 17 bp, Artificial sequence
  Synthetic oligonucleotide
acttgtacaggatggaa

SEQ ID NO: 731 - DNA, 17 bp, Artificial sequence
  Synthetic oligonucleotide
agcacttgtacaggatg

SEQ ID NO: 732 - DNA, 17 bp, Artificial sequence
  Synthetic oligonucleotide
ctgagcacttgtacagg

SEQ ID NO: 733 - DNA, 17 bp, Artificial sequence
  Synthetic oligonucleotide
gaactgagcacttgtac

SEQ ID NO: 734 - DNA, 17 bp, Artificial sequence
  Synthetic oligonucleotide
ttggaactgagcacttg

SEQ ID NO: 735 - DNA, 17 bp, Artificial sequence
  Synthetic oligonucleotide
acattggaactgagcac

SEQ ID NO: 736 - DNA, 17 bp, Artificial sequence
  Synthetic oligonucleotide
ggcacattggaactgag

SEQ ID NO: 737 - DNA, 17 bp, Artificial sequence
  Synthetic oligonucleotide
actgggcacattggaac

SEQ ID NO: 738 - DNA, 17 bp, Artificial sequence
  Synthetic oligonucleotide
atgactgggcacattgg

SEQ ID NO: 739 - DNA, 17 bp, Artificial sequence
  Synthetic oligonucleotide
gtcatgactgggcacat

SEQ ID NO: 740 - DNA, 17 bp, Artificial sequence
  Synthetic oligonucleotide
aatgtcatgactgggca

SEQ ID NO: 741 - DNA, 17 bp, Artificial sequence
  Synthetic oligonucleotide
agaaatgtcatgactgg

SEQ ID NO: 742 - DNA, 17 bp, Artificial sequence
  Synthetic oligonucleotide
ttgagaaatgtcatgac

SEQ ID NO: 743 - DNA, 17 bp, Artificial sequence
  Synthetic oligonucleotide
actttgagaaatgtcat

SEQ ID NO: 744 - DNA, 17 bp, Artificial sequence
  Synthetic oligonucleotide
aaaactttgagaaatgt

SEQ ID NO: 745 - DNA, 17 bp, Artificial sequence
  Synthetic oligonucleotide
gtaaaaactttgagaaa

SEQ ID NO: 746 - DNA, 17 bp, Artificial sequence
  Synthetic oligonucleotide
actgtaaaaactttgag

SEQ ID NO: 747 - DNA, 17 bp, Artificial sequence
  Synthetic oligonucleotide
tacactgtaaaaacttt

SEQ ID NO: 748 - DNA, 17 bp, Artificial sequence
  Synthetic oligonucleotide
agatacactgtaaaaac

SEQ ID NO: 749 - DNA, 17 bp, Artificial sequence
  Synthetic oligonucleotide
gagatacactgtaaaaa

SEQ ID NO: 750 - DNA, 17 bp, Artificial sequence
  Synthetic oligonucleotide
cgagatacactgtaaaa

SEQ ID NO: 751 - DNA, 17 bp, Artificial sequence
  Synthetic oligonucleotide
acttcgagatacactgt

SEQ ID NO: 752 - DNA, 17 bp, Artificial sequence
  Synthetic oligonucleotide
gaagacttcgagataca

SEQ ID NO: 753 - DNA, 17 bp, Artificial sequence
  Synthetic oligonucleotide
tggaagacttcgagata

SEQ ID NO: 754 - DNA, 17 bp, Artificial sequence
  Synthetic oligonucleotide
gatggaagacttcgaga

SEQ ID NO: 755 - DNA, 17 bp, Artificial sequence
  Synthetic oligonucleotide
gctgatggaagacttcg

SEQ ID NO: 756 - DNA, 17 bp, Artificial sequence
  Synthetic oligonucleotide
actgctgatggaagact

SEQ ID NO: 757 - DNA, 17 bp, Artificial sequence
  Synthetic oligonucleotide
atcactgctgatggaag

SEQ ID NO: 758 - DNA, 17 bp, Artificial sequence
  Synthetic oligonucleotide
ttcaatcactgctgatg

SEQ ID NO: 759 - DNA, 17 bp, Artificial sequence
  Synthetic oligonucleotide
tacttcaatcactgctg

SEQ ID NO: 760 - DNA, 17 bp, Artificial sequence
  Synthetic oligonucleotide
agatacttcaatcactg

SEQ ID NO: 761 - DNA, 17 bp, Artificial sequence
  Synthetic oligonucleotide
cagatacttcaatcact

SEQ ID NO: 762 - DNA, 17 bp, Artificial sequence
  Synthetic oligonucleotide
acagatacttcaatcac

SEQ ID NO: 763 - DNA, 17 bp, Artificial sequence
  Synthetic oligonucleotide
tacagatacttcaatca

SEQ ID NO: 764 - DNA, 17 bp, Artificial sequence
  Synthetic oligonucleotide
aggtacagatacttcaa

SEQ ID NO: 765 - DNA, 17 bp, Artificial sequence
  Synthetic oligonucleotide
ggcaggtacagatactt

SEQ ID NO: 766 - DNA, 17 bp, Artificial sequence
  Synthetic oligonucleotide
accgaaatgctgagtgg

SEQ ID NO: 767 - DNA, 17 bp, Artificial sequence
  Synthetic oligonucleotide
agcaccgaaatgctgag

SEQ ID NO: 768 - DNA, 17 bp, Artificial sequence
  Synthetic oligonucleotide
ggaagcaccgaaatgct

SEQ ID NO: 769 - DNA, 17 bp, Artificial sequence
  Synthetic oligonucleotide
aagggaagcaccgaaat

SEQ ID NO: 770 - DNA, 17 bp, Artificial sequence
  Synthetic oligonucleotide
tgaaagggaagcaccga

SEQ ID NO: 771 - DNA, 17 bp, Artificial sequence
  Synthetic oligonucleotide
cagtgaaagggaagcac

SEQ ID NO: 772 - DNA, 17 bp, Artificial sequence
  Synthetic oligonucleotide
cttcagtgaaagggaag

SEQ ID NO: 773 - DNA, 17 bp, Artificial sequence
  Synthetic oligonucleotide
cacttcagtgaaaggga

SEQ ID NO: 774 - DNA, 17 bp, Artificial sequence
  Synthetic oligonucleotide
ttcacttcagtgaaagg

SEQ ID NO: 775 - DNA, 17 bp, Artificial sequence
  Synthetic oligonucleotide
tattcacttcagtgaaa

SEQ ID NO: 776 - DNA, 17 bp, Artificial sequence
  Synthetic oligonucleotide
gtattcacttcagtgaa

SEQ ID NO: 777 - DNA, 17 bp, Artificial sequence
  Synthetic oligonucleotide
catgtattcacttcagt

SEQ ID NO: 778 - DNA, 17 bp, Artificial sequence
  Synthetic oligonucleotide
taccatgtattcacttc

SEQ ID NO: 779 - DNA, 17 bp, Artificial sequence
  Synthetic oligonucleotide
tgctaccatgtattcac

SEQ ID NO: 780 - DNA, 17 bp, Artificial sequence
  Synthetic oligonucleotide
ccctgctaccatgtatt

SEQ ID NO: 781 - DNA, 17 bp, Artificial sequence
  Synthetic oligonucleotide
agaccctgctaccatgt

SEQ ID NO: 782 - DNA, 17 bp, Artificial sequence
  Synthetic oligonucleotide
aagaccctgctaccatg

SEQ ID NO: 783 - DNA, 17 bp, Artificial sequence
  Synthetic oligonucleotide
cacaaagaccctgctac

SEQ ID NO: 784 - DNA, 17 bp, Artificial sequence
  Synthetic oligonucleotide
agcacacaaagaccctg

SEQ ID NO: 785 - DNA, 17 bp, Artificial sequence
  Synthetic oligonucleotide
acagcacacaaagaccc

SEQ ID NO: 786 - DNA, 17 bp, Artificial sequence
  Synthetic oligonucleotide
ccacagcacacaaagac

SEQ ID NO: 787 - DNA, 17 bp, Artificial sequence
  Synthetic oligonucleotide
aatccacagcacacaaa

SEQ ID NO: 788 - DNA, 17 bp, Artificial sequence
  Synthetic oligonucleotide
acaaaatccacagcaca

SEQ ID NO: 789 - DNA, 17 bp, Artificial sequence
  Synthetic oligonucleotide
gaagccacaaaatccac

SEQ ID NO: 790 - DNA, 17 bp, Artificial sequence
  Synthetic oligonucleotide
gattgaagccacaaaat

SEQ ID NO: 791 - DNA, 17 bp, Artificial sequence
  Synthetic oligonucleotide
gtagattgaagccacaa

SEQ ID NO: 792 - DNA, 17 bp, Artificial sequence
  Synthetic oligonucleotide
taatttgttttaacatc

SEQ ID NO: 793 - DNA, 17 bp, Artificial sequence
  Synthetic oligonucleotide
ggtgtttttaatttgtt

SEQ ID NO: 794 - DNA, 17 bp, Artificial sequence
  Synthetic oligonucleotide
ttaggtgtttttaattt

SEQ ID NO: 795 - DNA, 17 bp, Artificial sequence
  Synthetic oligonucleotide
tcacttaggtgttttta

SEQ ID NO: 796 - DNA, 17 bp, Artificial sequence
  Synthetic oligonucleotide
tagtcacttaggtgttt

SEQ ID NO: 797 - DNA, 17 bp, Artificial sequence
  Synthetic oligonucleotide
gtggtagtcacttaggt

SEQ ID NO: 798 - DNA, 17 bp, Artificial sequence
  Synthetic oligonucleotide
taagtggtagtcactta

SEQ ID NO: 799 - DNA, 17 bp, Artificial sequence
  Synthetic oligonucleotide
aaataagtggtagtcac

SEQ ID NO: 800 - DNA, 17 bp, Artificial sequence
  Synthetic oligonucleotide
tagaaataagtggtagt

SEQ ID NO: 801 - DNA, 17 bp, Artificial sequence
  Synthetic oligonucleotide
atttagaaataagtggt

SEQ ID NO: 802 - DNA, 17 bp, Artificial sequence
  Synthetic oligonucleotide
aggatttagaaataagt

SEQ ID NO: 803 - DNA, 17 bp, Artificial sequence
  Synthetic oligonucleotide
gtgaggatttagaaata

SEQ ID NO: 804 - DNA, 17 bp, Artificial sequence
  Synthetic oligonucleotide
agtgaggatttagaaat

SEQ ID NO: 805 - DNA, 17 bp, Artificial sequence
  Synthetic oligonucleotide
tagtgaggatttagaaa

SEQ ID NO: 806 - DNA, 17 bp, Artificial sequence
  Synthetic oligonucleotide
aatagtgaggatttaga

SEQ ID NO: 807 - DNA, 17 bp, Artificial sequence
  Synthetic oligonucleotide
aaaaatagtgaggattt

SEQ ID NO: 808 - DNA, 17 bp, Artificial sequence
  Synthetic oligonucleotide
caaaaaaatagtgagga

SEQ ID NO: 809 - DNA, 17 bp, Artificial sequence
  Synthetic oligonucleotide
gcaacaaaaaaatagtg

SEQ ID NO: 810 - DNA, 17 bp, Artificial sequence
  Synthetic oligonucleotide
cttctgaacaacagcaa

SEQ ID NO: 811 - DNA, 17 bp, Artificial sequence
  Synthetic oligonucleotide
caacttctgaacaacag

SEQ ID NO: 812 - DNA, 17 bp, Artificial sequence
  Synthetic oligonucleotide
taacaacttctgaacaa

SEQ ID NO: 813 - DNA, 17 bp, Artificial sequence
  Synthetic oligonucleotide
cactaacaacttctgaa

SEQ ID NO: 814 - DNA, 17 bp, Artificial sequence
  Synthetic oligonucleotide
aatcactaacaacttct

SEQ ID NO: 815 - DNA, 17 bp, Artificial sequence
  Synthetic oligonucleotide
gcaaatcactaacaact

SEQ ID NO: 816 - DNA, 17 bp, Artificial sequence
  Synthetic oligonucleotide
atagcaaatcactaaca

SEQ ID NO: 817 - DNA, 17 bp, Artificial sequence
  Synthetic oligonucleotide
tatgatagcaaatcact

SEQ ID NO: 818 - DNA, 17 bp, Artificial sequence
  Synthetic oligonucleotide
atatatgatagcaaatc

SEQ ID NO: 819 - DNA, 17 bp, Artificial sequence
  Synthetic oligonucleotide
ataatatatgatagcaa

SEQ ID NO: 820 - DNA, 17 bp, Artificial sequence
  Synthetic oligonucleotide
cttataatatatgatag

SEQ ID NO: 821 - DNA, 17 bp, Artificial sequence
  Synthetic oligonucleotide
aatcttataatatatga

SEQ ID NO: 822 - DNA, 17 bp, Artificial sequence
  Synthetic oligonucleotide
ctaaaaatcttataata

SEQ ID NO: 823 - DNA, 17 bp, Artificial sequence
  Synthetic oligonucleotide
cacctaaaaatcttata

SEQ ID NO: 824 - DNA, 17 bp, Artificial sequence
  Synthetic oligonucleotide
agacacctaaaaatctt

SEQ ID NO: 825 - DNA, 17 bp, Artificial sequence
  Synthetic oligonucleotide
aagacacctaaaaatct

SEQ ID NO: 826 - DNA, 17 bp, Artificial sequence
  Synthetic oligonucleotide
aaagacacctaaaaatc

SEQ ID NO: 827 - DNA, 17 bp, Artificial sequence
  Synthetic oligonucleotide
ttaaaagacacctaaaa

SEQ ID NO: 828 - DNA, 17 bp, Artificial sequence
  Synthetic oligonucleotide
tcattaaaagacaccta

SEQ ID NO: 829 - DNA, 17 bp, Artificial sequence
  Synthetic oligonucleotide
gtatcattaaaagacac

SEQ ID NO: 830 - DNA, 17 bp, Artificial sequence
  Synthetic oligonucleotide
acagtatcattaaaaga

SEQ ID NO: 831 - DNA, 17 bp, Artificial sequence
  Synthetic oligonucleotide
tagacagtatcattaaa

SEQ ID NO: 832 - DNA, 17 bp, Artificial sequence
  Synthetic oligonucleotide
ttcttagacagtatcat

SEQ ID NO: 833 - DNA, 17 bp, Artificial sequence
  Synthetic oligonucleotide
ttattcttagacagtat

SEQ ID NO: 834 - DNA, 17 bp, Artificial sequence
  Synthetic oligonucleotide
tcattattcttagacag

SEQ ID NO: 835 - DNA, 17 bp, Artificial sequence
  Synthetic oligonucleotide
aacaaatttcacaatac

SEQ ID NO: 836 - DNA, 17 bp, Artificial sequence
  Synthetic oligonucleotide
attaacaaatttcacaa

SEQ ID NO: 837 - DNA, 17 bp, Artificial sequence
  Synthetic oligonucleotide
gtattatatatattaac

SEQ ID NO: 838 - DNA, 17 bp, Artificial sequence
  Synthetic oligonucleotide
ctcacatatttttaagt

SEQ ID NO: 839 - DNA, 17 bp, Artificial sequence
  Synthetic oligonucleotide
atgctcacatattttta

SEQ ID NO: 840 - DNA, 17 bp, Artificial sequence
  Synthetic oligonucleotide
ttcatgctcacatattt

SEQ ID NO: 841 - DNA, 17 bp, Artificial sequence
  Synthetic oligonucleotide
agtttcatgctcacata

SEQ ID NO: 842 - DNA, 17 bp, Artificial sequence
  Synthetic oligonucleotide
gcatagtttcatgctca

SEQ ID NO: 843 - DNA, 17 bp, Artificial sequence
  Synthetic oligonucleotide
ggtgcatagtttcatgc

SEQ ID NO: 844 - DNA, 17 bp, Artificial sequence
  Synthetic oligonucleotide
aggtgcatagtttcatg

SEQ ID NO: 845 - DNA, 17 bp, Artificial sequence
  Synthetic oligonucleotide
ataggtgcatagtttca

SEQ ID NO: 846 - DNA, 17 bp, Artificial sequence
  Synthetic oligonucleotide
tttataggtgcatagtt

SEQ ID NO: 847 - DNA, 17 bp, Artificial sequence
  Synthetic oligonucleotide
gtatttataggtgcata

SEQ ID NO: 848 - DNA, 17 bp, Artificial sequence
  Synthetic oligonucleotide
ttagtatttataggtgc

SEQ ID NO: 849 - DNA, 17 bp, Artificial sequence
  Synthetic oligonucleotide
tatttagtatttatagg

SEQ ID NO: 850 - DNA, 17 bp, Artificial sequence
  Synthetic oligonucleotide
ggtaaaatttcatattt

SEQ ID NO: 851 - DNA, 17 bp, Artificial sequence
  Synthetic oligonucleotide
tcgcaaaatggtaaaat

SEQ ID NO: 852 - DNA, 17 bp, Artificial sequence
  Synthetic oligonucleotide
acatcgcaaaatggtaa

SEQ ID NO: 853 - DNA, 17 bp, Artificial sequence
  Synthetic oligonucleotide
aacacatcgcaaaatgg

SEQ ID NO: 854 - DNA, 17 bp, Artificial sequence
  Synthetic oligonucleotide
taaaacacatcgcaaaa

SEQ ID NO: 855 - DNA, 17 bp, Artificial sequence
  Synthetic oligonucleotide
gaataaaacacatcgca

SEQ ID NO: 856 - DNA, 17 bp, Artificial sequence
  Synthetic oligonucleotide
agtgaataaaacacatc

SEQ ID NO: 857 - DNA, 17 bp, Artificial sequence
  Synthetic oligonucleotide
acaagtgaataaaacac

SEQ ID NO: 858 - DNA, 17 bp, Artificial sequence
  Synthetic oligonucleotide
caaacacaagtgaataa

SEQ ID NO: 859 - DNA, 17 bp, Artificial sequence
  Synthetic oligonucleotide
atacaaacacaagtgaa

SEQ ID NO: 860 - DNA, 17 bp, Artificial sequence
  Synthetic oligonucleotide
ttatatacaaacacaag

SEQ ID NO: 861 - DNA, 17 bp, Artificial sequence
  Synthetic oligonucleotide
ccatttatatacaaaca

SEQ ID NO: 862 - DNA, 17 bp, Artificial sequence
  Synthetic oligonucleotide
tcaccatttatatacaa

SEQ ID NO: 863 - DNA, 17 bp, Artificial sequence
  Synthetic oligonucleotide
attctcaccatttatat

SEQ ID NO: 864 - DNA, 17 bp, Artificial sequence
  Synthetic oligonucleotide
ttattttaattctcacc

SEQ ID NO: 865 - DNA, 17 bp, Artificial sequence
  Synthetic oligonucleotide
ttttgcaatgagataac

SEQ ID NO: 866 - DNA, 17 bp, Artificial sequence
  Synthetic oligonucleotide
tatttttgcaatgagat

SEQ ID NO: 867 - DNA, 17 bp, Artificial sequence
  Synthetic oligonucleotide
gagatgggataaaaata

SEQ ID NO: 868 - DNA, 17 bp, Artificial sequence
  Synthetic oligonucleotide
agtgagatgggataaaa

SEQ ID NO: 869 - DNA, 17 bp, Artificial sequence
  Synthetic oligonucleotide
taaagtgagatgggata

SEQ ID NO: 870 - DNA, 17 bp, Artificial sequence
  Synthetic oligonucleotide
ttattaaagtgagatgg

SEQ ID NO: 871 - DNA, 17 bp, Artificial sequence
  Synthetic oligonucleotide
ttattattaaagtgaga

SEQ ID NO: 872 - DNA, 17 bp, Artificial sequence
  Synthetic oligonucleotide
agcatgatttttattat

SEQ ID NO: 873 - DNA, 17 bp, Artificial sequence
  Synthetic oligonucleotide
ataagcatgatttttat

SEQ ID NO: 874 - DNA, 17 bp, Artificial sequence
  Synthetic oligonucleotide
tataagcatgattttta

SEQ ID NO: 875 - DNA, 17 bp, Artificial sequence
  Synthetic oligonucleotide
tgcttataagcatgatt

SEQ ID NO: 876 - DNA, 17 bp, Artificial sequence
  Synthetic oligonucleotide
tgttgcttataagcatg

SEQ ID NO: 877 - DNA, 17 bp, Artificial sequence
  Synthetic oligonucleotide
tcatgttgcttataagc

SEQ ID NO: 878 - DNA, 17 bp, Artificial sequence
  Synthetic oligonucleotide
taattcatgttgcttat

SEQ ID NO: 879 - DNA, 17 bp, Artificial sequence
  Synthetic oligonucleotide
tcttaattcatgttgct

SEQ ID NO: 880 - DNA, 17 bp, Artificial sequence
  Synthetic oligonucleotide
agttcttaattcatgtt

SEQ ID NO: 881 - DNA, 17 bp, Artificial sequence
  Synthetic oligonucleotide
gtcagttcttaattcat

SEQ ID NO: 882 - DNA, 17 bp, Artificial sequence
  Synthetic oligonucleotide
tgtgtcagttcttaatt

SEQ ID NO: 883 - DNA, 17 bp, Artificial sequence
  Synthetic oligonucleotide
ctttgtgtcagttctta

SEQ ID NO: 884 - DNA, 17 bp, Artificial sequence
  Synthetic oligonucleotide
gtcctttgtgtcagttc

SEQ ID NO: 885 - DNA, 17 bp, Artificial sequence
  Synthetic oligonucleotide
ttttgtcctttgtgtca

SEQ ID NO: 886 - DNA, 17 bp, Artificial sequence
  Synthetic oligonucleotide
tatttttgtcctttgtg

SEQ ID NO: 887 - DNA, 17 bp, Artificial sequence
  Synthetic oligonucleotide
ctttatatttttgtcct

SEQ ID NO: 888 - DNA, 17 bp, Artificial sequence
  Synthetic oligonucleotide
ctattaataactttata

SEQ ID NO: 889 - DNA, 17 bp, Artificial sequence
  Synthetic oligonucleotide
tggctattaataacttt

SEQ ID NO: 890 - DNA, 17 bp, Artificial sequence
  Synthetic oligonucleotide
aaatggctattaataac

SEQ ID NO: 891 - DNA, 17 bp, Artificial sequence
  Synthetic oligonucleotide
ttcaaatggctattaat

SEQ ID NO: 892 - DNA, 17 bp, Artificial sequence
  Synthetic oligonucleotide
ttcttcaaatggctatt

SEQ ID NO: 893 - DNA, 17 bp, Artificial sequence
  Synthetic oligonucleotide
tccttcttcaaatggct

SEQ ID NO: 894 - DNA, 17 bp, Artificial sequence
  Synthetic oligonucleotide
tcctccttcttcaaatg

SEQ ID NO: 895 - DNA, 17 bp, Artificial sequence
  Synthetic oligonucleotide
aaaattcctccttcttc

SEQ ID NO: 896 - DNA, 17 bp, Artificial sequence
  Synthetic oligonucleotide
tctaaaattcctccttc

SEQ ID NO: 897 - DNA, 17 bp, Artificial sequence
  Synthetic oligonucleotide
tcttctaaaattcctcc

SEQ ID NO: 898 - DNA, 17 bp, Artificial sequence
  Synthetic oligonucleotide
acctcttctaaaattcc

SEQ ID NO: 899 - DNA, 17 bp, Artificial sequence
  Synthetic oligonucleotide
tctacctcttctaaaat

SEQ ID NO: 900 - DNA, 17 bp, Artificial sequence
  Synthetic oligonucleotide
ttctctacctcttctaa

SEQ ID NO: 901 - DNA, 17 bp, Artificial sequence
  Synthetic oligonucleotide
ccattttctctacctct

SEQ ID NO: 902 - DNA, 17 bp, Artificial sequence
  Synthetic oligonucleotide
gttccattttctctacc

SEQ ID NO: 903 - DNA, 17 bp, Artificial sequence
  Synthetic oligonucleotide
taatgttccattttctc

SEQ ID NO: 904 - DNA, 17 bp, Artificial sequence
  Synthetic oligonucleotide
gggttaatgttccattt

SEQ ID NO: 905 - DNA, 17 bp, Artificial sequence
  Synthetic oligonucleotide
gtagggttaatgttcca

SEQ ID NO: 906 - DNA, 17 bp, Artificial sequence
  Synthetic oligonucleotide
agtgtagggttaatgtt

SEQ ID NO: 907 - DNA, 17 bp, Artificial sequence
  Synthetic oligonucleotide
ccgagtgtagggttaat

SEQ ID NO: 908 - DNA, 17 bp, Artificial sequence
  Synthetic oligonucleotide
attccgagtgtagggtt

SEQ ID NO: 909 - DNA, 17 bp, Artificial sequence
  Synthetic oligonucleotide
ggaattccgagtgtagg

SEQ ID NO: 910 - DNA, 17 bp, Artificial sequence
  Synthetic oligonucleotide
cagggaattccgagtgt

SEQ ID NO: 911 - DNA, 17 bp, Artificial sequence
  Synthetic oligonucleotide
gcttcagggaattccga

SEQ ID NO: 912 - DNA, 17 bp, Artificial sequence
  Synthetic oligonucleotide
gttgcttcagggaattc

SEQ ID NO: 913 - DNA, 17 bp, Artificial sequence
  Synthetic oligonucleotide
agtgttgcttcagggaa

SEQ ID NO: 914 - DNA, 17 bp, Artificial sequence
  Synthetic oligonucleotide
ggcagtgttgcttcagg

SEQ ID NO: 915 - DNA, 17 bp, Artificial sequence
  Synthetic oligonucleotide
tctggcagtgttgcttc

SEQ ID NO: 916 - DNA, 17 bp, Artificial sequence
  Synthetic oligonucleotide
acttctggcagtgttgc

SEQ ID NO: 917 - DNA, 17 bp, Artificial sequence
  Synthetic oligonucleotide
cacacttctggcagtgt

SEQ ID NO: 918 - DNA, 17 bp, Artificial sequence
  Synthetic oligonucleotide
aaaacacacttctggca

SEQ ID NO: 919 - DNA, 17 bp, Artificial sequence
  Synthetic oligonucleotide
accaaaacacacttctg

SEQ ID NO: 920 - DNA, 17 bp, Artificial sequence
  Synthetic oligonucleotide
cataccaaaacacactt

SEQ ID NO: 921 - DNA, 17 bp, Artificial sequence
  Synthetic oligonucleotide
gtgcataccaaaacaca

SEQ ID NO: 922 - DNA, 17 bp, Artificial sequence
  Synthetic oligonucleotide
ccagtgcataccaaaac

SEQ ID NO: 923 - DNA, 17 bp, Artificial sequence
  Synthetic oligonucleotide
gaaccagtgcataccaa

SEQ ID NO: 924 - DNA, 17 bp, Artificial sequence
  Synthetic oligonucleotide
aaggaaccagtgcatac

SEQ ID NO: 925 - DNA, 17 bp, Artificial sequence
  Synthetic oligonucleotide
acttaaggaaccagtgc

SEQ ID NO: 926 - DNA, 17 bp, Artificial sequence
  Synthetic oligonucleotide
gccacttaaggaaccag

SEQ ID NO: 927 - DNA, 17 bp, Artificial sequence
  Synthetic oligonucleotide
acagccacttaaggaac

SEQ ID NO: 928 - DNA, 17 bp, Artificial sequence
  Synthetic oligonucleotide
atcacagccacttaagg

SEQ ID NO: 929 - DNA, 17 bp, Artificial sequence
  Synthetic oligonucleotide
ttaatcacagccactta

SEQ ID NO: 930 - DNA, 17 bp, Artificial sequence
  Synthetic oligonucleotide
taattaatcacagccac

SEQ ID NO: 931 - DNA, 17 bp, Artificial sequence
  Synthetic oligonucleotide
caataattaatcacagc

SEQ ID NO: 932 - DNA, 17 bp, Artificial sequence
  Synthetic oligonucleotide
ctttcaataattaatca

SEQ ID NO: 933 - DNA, 17 bp, Artificial sequence
  Synthetic oligonucleotide
cccactttcaataatta

SEQ ID NO: 934 - DNA, 17 bp, Artificial sequence
  Synthetic oligonucleotide
tctacaatagtagttgg

SEQ ID NO: 935 - DNA, 17 bp, Artificial sequence
  Synthetic oligonucleotide
cactctacaatagtagt

SEQ ID NO: 936 - DNA, 17 bp, Artificial sequence
  Synthetic oligonucleotide
gaccactctacaatagt

SEQ ID NO: 937 - DNA, 17 bp, Artificial sequence
  Synthetic oligonucleotide
atagaccactctacaat

SEQ ID NO: 938 - DNA, 17 bp, Artificial sequence
  Synthetic oligonucleotide
gaaatagaccactctac

SEQ ID NO: 939 - DNA, 17 bp, Artificial sequence
  Synthetic oligonucleotide
ggagaaatagaccactc

SEQ ID NO: 940 - DNA, 17 bp, Artificial sequence
  Synthetic oligonucleotide
ggattgaagggagaaat

SEQ ID NO: 941 - DNA, 17 bp, Artificial sequence
  Synthetic oligonucleotide
acaggattgaagggaga

SEQ ID NO: 942 - DNA, 17 bp, Artificial sequence
  Synthetic oligonucleotide
ttgacaggattgaaggg

SEQ ID NO: 943 - DNA, 17 bp, Artificial sequence
  Synthetic oligonucleotide
acattgacaggattgaa

SEQ ID NO: 944 - DNA, 17 bp, Artificial sequence
  Synthetic oligonucleotide
caaacattgacaggatt

SEQ ID NO: 945 - DNA, 17 bp, Artificial sequence
  Synthetic oligonucleotide
acagttccccaaaatac

SEQ ID NO: 946 - DNA, 17 bp, Artificial sequence
  Synthetic oligonucleotide
acaacagttccccaaaa

SEQ ID NO: 947 - DNA, 17 bp, Artificial sequence
  Synthetic oligonucleotide
caaacaacagttcccca

SEQ ID NO: 948 - DNA, 17 bp, Artificial sequence
  Synthetic oligonucleotide
catcaaacaacagttcc

SEQ ID NO: 949 - DNA, 17 bp, Artificial sequence
  Synthetic oligonucleotide
acacatcaaacaacagt

SEQ ID NO: 950 - DNA, 17 bp, Artificial sequence
  Synthetic oligonucleotide
catacacatcaaacaac

SEQ ID NO: 951 - DNA, 17 bp, Artificial sequence
  Synthetic oligonucleotide
gctcaattaaaaatgta

SEQ ID NO: 952 - DNA, 17 bp, Artificial sequence
  Synthetic oligonucleotide
aaggctcaattaaaaat

SEQ ID NO: 953 - DNA, 17 bp, Artificial sequence
  Synthetic oligonucleotide
ttaataaaaggctcaat

SEQ ID NO: 954 - DNA, 17 bp, Artificial sequence
  Synthetic oligonucleotide
atgttaataaaaggctc

SEQ ID NO: 955 - DNA, 17 bp, Artificial sequence
  Synthetic oligonucleotide
acaatatatgttaataa

SEQ ID NO: 956 - DNA, 17 bp, Artificial sequence
  Synthetic oligonucleotide
tcgagacaaaaataaca

SEQ ID NO: 957 - DNA, 17 bp, Artificial sequence
  Synthetic oligonucleotide
atttcgagacaaaaata

SEQ ID NO: 958 - DNA, 17 bp, Artificial sequence
  Synthetic oligonucleotide
attatttcgagacaaaa

SEQ ID NO: 959 - DNA, 17 bp, Artificial sequence
  Synthetic oligonucleotide
aaaattatttcgagaca

SEQ ID NO: 960 - DNA, 17 bp, Artificial sequence
  Synthetic oligonucleotide
taaaaaattatttcgag

SEQ ID NO: 961 - DNA, 17 bp, Artificial sequence
  Synthetic oligonucleotide
atagattttaactaaaa

SEQ ID NO: 962 - DNA, 17 bp, Artificial sequence
  Synthetic oligonucleotide
ttcacaccaatatcaga

SEQ ID NO: 963 - DNA, 17 bp, Artificial sequence
  Synthetic oligonucleotide
gcattcacaccaatatc

SEQ ID NO: 964 - DNA, 17 bp, Artificial sequence
  Synthetic oligonucleotide
acagcattcacaccaat

SEQ ID NO: 965 - DNA, 17 bp, Artificial sequence
  Synthetic oligonucleotide
ggtacagcattcacacc

SEQ ID NO: 966 - DNA, 17 bp, Artificial sequence
  Synthetic oligonucleotide
aaaggtacagcattcac

SEQ ID NO: 967 - DNA, 17 bp, Artificial sequence
  Synthetic oligonucleotide
cagaaaggtacagcatt

SEQ ID NO: 968 - DNA, 17 bp, Artificial sequence
  Synthetic oligonucleotide
tgtcagaaaggtacagc

SEQ ID NO: 969 - DNA, 17 bp, Artificial sequence
  Synthetic oligonucleotide
ttattgtcagaaaggta

SEQ ID NO: 970 - DNA, 17 bp, Artificial sequence
  Synthetic oligonucleotide
tatttattgtcagaaag

SEQ ID NO: 971 - DNA, 17 bp, Artificial sequence
  Synthetic oligonucleotide
tattatttattgtcaga

SEQ ID NO: 972 - DNA, 17 bp, Artificial sequence
  Synthetic oligonucleotide
gaatattatttattgtc

SEQ ID NO: 973 - DNA, 17 bp, Artificial sequence
  Synthetic oligonucleotide
ggtcgaatattatttat

SEQ ID NO: 974 - DNA, 17 bp, Artificial sequence
  Synthetic oligonucleotide
tcatggtcgaatattat

SEQ ID NO: 975 - DNA, 17 bp, Artificial sequence
  Synthetic oligonucleotide
tattcatggtcgaatat

SEQ ID NO: 976 - DNA, 17 bp, Artificial sequence
  Synthetic oligonucleotide
ttttattcatggtcgaa

SEQ ID NO: 977 - DNA, 17 bp, Artificial sequence
  Synthetic oligonucleotide
tttttttattcatggtc

SEQ ID NO: 978 - DNA, 17 bp, Artificial sequence
  Synthetic oligonucleotide
ggaacccactttttttt

SEQ ID NO: 979 - DNA, 17 bp, Artificial sequence
  Synthetic oligonucleotide
ccgggaacccacttttt

SEQ ID NO: 980 - DNA, 17 bp, Artificial sequence
  Synthetic oligonucleotide
ttcccgggaacccactt

SEQ ID NO: 981 - DNA, 17 bp, Artificial sequence
  Synthetic oligonucleotide
tagttcccgggaaccca

SEQ ID NO: 982 - DNA, 17 bp, Artificial sequence
  Synthetic oligonucleotide
tgcttagttcccgggaa

SEQ ID NO: 983 - DNA, 17 bp, Artificial sequence
  Synthetic oligonucleotide
cactgcttagttcccgg

SEQ ID NO: 984 - DNA, 17 bp, Artificial sequence
  Synthetic oligonucleotide
ctacactgcttagttcc

SEQ ID NO: 985 - DNA, 17 bp, Artificial sequence
  Synthetic oligonucleotide
cttctacactgcttagt

SEQ ID NO: 986 - DNA, 17 bp, Artificial sequence
  Synthetic oligonucleotide
catcttctacactgctt

SEQ ID NO: 987 - DNA, 17 bp, Artificial sequence
  Synthetic oligonucleotide
aatcatcttctacactg

SEQ ID NO: 988 - DNA, 17 bp, Artificial sequence
  Synthetic oligonucleotide
caaaatcatcttctaca

SEQ ID NO: 989 - DNA, 17 bp, Artificial sequence
  Synthetic oligonucleotide
tagtcaaaatcatcttc

SEQ ID NO: 990 - DNA, 17 bp, Artificial sequence
  Synthetic oligonucleotide
gtgtagtcaaaatcatc

SEQ ID NO: 991 - DNA, 17 bp, Artificial sequence
  Synthetic oligonucleotide
agggtgtagtcaaaatc

SEQ ID NO: 992 - DNA, 17 bp, Artificial sequence
  Synthetic oligonucleotide
aggagggtgtagtcaaa

SEQ ID NO: 993 - DNA, 17 bp, Artificial sequence
  Synthetic oligonucleotide
ctaaggagggtgtagtc

SEQ ID NO: 994 - DNA, 17 bp, Artificial sequence
  Synthetic oligonucleotide
tctctaaggagggtgta

SEQ ID NO: 995 - DNA, 17 bp, Artificial sequence
  Synthetic oligonucleotide
ggctctctaaggagggt

SEQ ID NO: 996 - DNA, 17 bp, Artificial sequence
  Synthetic oligonucleotide
ttatggctctctaagga

SEQ ID NO: 997 - DNA, 17 bp, Artificial sequence
  Synthetic oligonucleotide
gtcttatggctctctaa

SEQ ID NO: 998 - DNA, 17 bp, Artificial sequence
  Synthetic oligonucleotide
tgtgtcttatggctctc

SEQ ID NO: 999 - DNA, 17 bp, Artificial sequence
  Synthetic oligonucleotide
taatgtgtcttatggct

SEQ ID NO: 1000 - DNA, 17 bp, Artificial sequence
  Synthetic oligonucleotide
tgctaatgtgtcttatg

SEQ ID NO: 1001 - DNA, 17 bp, Artificial sequence
  Synthetic oligonucleotide
atgtgctaatgtgtctt

SEQ ID NO: 1002 - DNA, 17 bp, Artificial sequence
  Synthetic oligonucleotide
aatatgtgctaatgtgt

SEQ ID NO: 1003 - DNA, 17 bp, Artificial sequence
  Synthetic oligonucleotide
tgctaatatgtgctaat

SEQ ID NO: 1004 - DNA, 17 bp, Artificial sequence
  Synthetic oligonucleotide
atgtgctaatatgtgct

SEQ ID NO: 1005 - DNA, 17 bp, Artificial sequence
  Synthetic oligonucleotide
tgaatgtgctaatatgt

SEQ ID NO: 1006 - DNA, 17 bp, Artificial sequence
  Synthetic oligonucleotide
ccttgaatgtgctaata

SEQ ID NO: 1007 - DNA, 17 bp, Artificial sequence
  Synthetic oligonucleotide
gagccttgaatgtgcta

SEQ ID NO: 1008 - DNA, 17 bp, Artificial sequence
  Synthetic oligonucleotide
tcagagccttgaatgtg

SEQ ID NO: 1009 - DNA, 17 bp, Artificial sequence
  Synthetic oligonucleotide
ctctcagagccttgaat

SEQ ID NO: 1010 - DNA, 17 bp, Artificial sequence
  Synthetic oligonucleotide
ttctctcagagccttga

SEQ ID NO: 1011 - DNA, 17 bp, Artificial sequence
  Synthetic oligonucleotide
cattctctcagagcctt

SEQ ID NO: 1012 - DNA, 17 bp, Artificial sequence
  Synthetic oligonucleotide
cacattctctcagagcc

SEQ ID NO: 1013 - DNA, 17 bp, Artificial sequence
  Synthetic oligonucleotide
ccacattctctcagagc

SEQ ID NO: 1014 - DNA, 17 bp, Artificial sequence
  Synthetic oligonucleotide
taaaggcatttcctgta

SEQ ID NO: 1015 - DNA, 17 bp, Artificial sequence
  Synthetic oligonucleotide
ggcaacatttaaaggag

SEQ ID NO: 1016 - DNA, 17 bp, Artificial sequence
  Synthetic oligonucleotide
gaaatgactatgcccca

SEQ ID NO: 1017 - DNA, 17 bp, Artificial sequence
  Synthetic oligonucleotide
aaactgctagcatgtct

SEQ ID NO: 1018 - DNA, 17 bp, Artificial sequence
  Synthetic oligonucleotide
tgtagtagtctctcttc

SEQ ID NO: 1019 - DNA, 17 bp, Artificial sequence
  Synthetic oligonucleotide
tgtttaagtgtttggtc

SEQ ID NO: 1020 - DNA, 17 bp, Artificial sequence
  Synthetic oligonucleotide
ggactggattgatcctc

SEQ ID NO: 1021 - DNA, 17 bp, Artificial sequence
  Synthetic oligonucleotide
acatactggataagcca

SEQ ID NO: 1022 - DNA, 17 bp, Artificial sequence
  Synthetic oligonucleotide
cctggatcacaccagaa

SEQ ID NO: 1023 - DNA, 17 bp, Artificial sequence
  Synthetic oligonucleotide
gttcctggatcacacca

SEQ ID NO: 1024 - DNA, 17 bp, Artificial sequence
  Synthetic oligonucleotide
gctgttcctggatcaca

SEQ ID NO: 1025 - DNA, 17 bp, Artificial sequence
  Synthetic oligonucleotide
acagctgttcctggatc

SEQ ID NO: 1026 - DNA, 17 bp, Artificial sequence
  Synthetic oligonucleotide
aagacagctgttcctgg

SEQ ID NO: 1027 - DNA, 17 bp, Artificial sequence
  Synthetic oligonucleotide
tggaagacagctgttcc

SEQ ID NO: 1028 - DNA, 17 bp, Artificial sequence
  Synthetic oligonucleotide
agctggaagacagctgt

SEQ ID NO: 1029 - DNA, 17 bp, Artificial sequence
  Synthetic oligonucleotide
cagagctggaagacagc

SEQ ID NO: 1030 - DNA, 17 bp, Artificial sequence
  Synthetic oligonucleotide
tctttcagagctggaag

SEQ ID NO: 1031 - DNA, 17 bp, Artificial sequence
  Synthetic oligonucleotide
cctgagtccctctgctt

SEQ ID NO: 1032 - DNA, 17 bp, Artificial sequence
  Synthetic oligonucleotide
taatctctcagcccttg

SEQ ID NO: 1033 - DNA, 17 bp, Artificial sequence
  Synthetic oligonucleotide
ccaccctagcggacccc

SEQ ID NO: 1034 - DNA, 17 bp, Artificial sequence
  Synthetic oligonucleotide
ccagaagaaggctaaca

SEQ ID NO: 1035 - DNA, 17 bp, Artificial sequence
  Synthetic oligonucleotide
ggcattaaaaatttagc

SEQ ID NO: 1036 - DNA, 17 bp, Artificial sequence
  Synthetic oligonucleotide
tttacaccacactggaa

SEQ ID NO: 1037 - DNA, 17 bp, Artificial sequence
  Synthetic oligonucleotide
ctttacaccacactgga

SEQ ID NO: 1038 - DNA, 17 bp, Artificial sequence
  Synthetic oligonucleotide
cctttacaccacactgg

SEQ ID NO: 1039 - DNA, 17 bp, Artificial sequence
  Synthetic oligonucleotide
acctacatagagaacac

SEQ ID NO: 1040 - DNA, 17 bp, Artificial sequence
  Synthetic oligonucleotide
ggcaaaattaaaaatct

SEQ ID NO: 1041 - DNA, 17 bp, Artificial sequence
  Synthetic oligonucleotide
ttatacacatcacaggg

SEQ ID NO: 1042 - DNA, 17 bp, Artificial sequence
  Synthetic oligonucleotide
aaggtggaactttagga

SEQ ID NO: 1043 - DNA, 17 bp, Artificial sequence
  Synthetic oligonucleotide
gactcttactgctatag

SEQ ID NO: 1044 - DNA, 17 bp, Artificial sequence
  Synthetic oligonucleotide
tgatagcatcactgcag

SEQ ID NO: 1045 - DNA, 17 bp, Artificial sequence
  Synthetic oligonucleotide
aactcatcaattttttc

SEQ ID NO: 1046 - DNA, 17 bp, Artificial sequence
  Synthetic oligonucleotide
gtaaccaataaaaaatt

SEQ ID NO: 1047 - DNA, 17 bp, Artificial sequence
  Synthetic oligonucleotide
gttgtttgtagacacag

SEQ ID NO: 1048 - DNA, 17 bp, Artificial sequence
  Synthetic oligonucleotide
tgtttatgactaccttc

SEQ ID NO: 1049 - DNA, 17 bp, Artificial sequence
  Synthetic oligonucleotide
attttttactaatcagg

SEQ ID NO: 1050 - DNA, 17 bp, Artificial sequence
  Synthetic oligonucleotide
gtcatttgaagaaattt

SEQ ID NO: 1051 - DNA, 17 bp, Artificial sequence
  Synthetic oligonucleotide
gtgcatgttatgttgac

SEQ ID NO: 1052 - DNA, 17 bp, Artificial sequence
  Synthetic oligonucleotide
ttatgagtaatctgtaa

SEQ ID NO: 1053 - DNA, 17 bp, Artificial sequence
  Synthetic oligonucleotide
gccactaaaccacacca

SEQ ID NO: 1054 - DNA, 17 bp, Artificial sequence
  Synthetic oligonucleotide
gggatgatgagatcagg

SEQ ID NO: 1055 - DNA, 17 bp, Artificial sequence
  Synthetic oligonucleotide
ttttagctgcccttgcc

SEQ ID NO: 1056 - DNA, 17 bp, Artificial sequence
  Synthetic oligonucleotide
ttatctcacatatatgt

SEQ ID NO: 1057 - DNA, 17 bp, Artificial sequence
  Synthetic oligonucleotide
acaccactccattgcag

SEQ ID NO: 1058 - DNA, 17 bp, Artificial sequence
  Synthetic oligonucleotide
ggagtggacatgttttt

SEQ ID NO: 1059 - DNA, 17 bp, Artificial sequence
  Synthetic oligonucleotide
caacacagtggctcttg

SEQ ID NO: 1060 - DNA, 17 bp, Artificial sequence
  Synthetic oligonucleotide
gaatgataaatgtttca

SEQ ID NO: 1061 - DNA, 17 bp, Artificial sequence
  Synthetic oligonucleotide
agatagaagtagagagt

SEQ ID NO: 1062 - DNA, 17 bp, Artificial sequence
  Synthetic oligonucleotide
ttgtttgtgctggaact

SEQ ID NO: 1063 - DNA, 17 bp, Artificial sequence
  Synthetic oligonucleotide
cataacagatgtgaagc

SEQ ID NO: 1064 - DNA, 17 bp, Artificial sequence
  Synthetic oligonucleotide
tgcagcagtgacaacat

SEQ ID NO: 1065 - DNA, 17 bp, Artificial sequence
  Synthetic oligonucleotide
tttacagaattatcata

SEQ ID NO: 1066 - DNA, 17 bp, Artificial sequence
  Synthetic oligonucleotide
cattacacatgtaataa

SEQ ID NO: 1067 - DNA, 17 bp, Artificial sequence
  Synthetic oligonucleotide
cattatgtaaaaaaaac

SEQ ID NO: 1068 - DNA, 17 bp, Artificial sequence
  Synthetic oligonucleotide
tacgattttagcacaaa

SEQ ID NO: 1069 - DNA, 17 bp, Artificial sequence
  Synthetic oligonucleotide
cctacaaaaacaaattc

SEQ ID NO: 1070 - DNA, 17 bp, Artificial sequence
  Synthetic oligonucleotide
ggttttggagcctacaa

SEQ ID NO: 1071 - DNA, 17 bp, Artificial sequence
  Synthetic oligonucleotide
gcaagtatattttttat

SEQ ID NO: 1072 - DNA, 17 bp, Artificial sequence
  Synthetic oligonucleotide
cctgaaatgcactctga

SEQ ID NO: 1073 - DNA, 17 bp, Artificial sequence
  Synthetic oligonucleotide
ctcatcttcctcaacat

SEQ ID NO: 1074 - DNA, 17 bp, Artificial sequence
  Synthetic oligonucleotide
tccattttagaagtcag

SEQ ID NO: 1075 - DNA, 17 bp, Artificial sequence
  Synthetic oligonucleotide
taacacttataaaatac

SEQ ID NO: 1076 - DNA, 17 bp, Artificial sequence
  Synthetic oligonucleotide
gaggtccctagaaggca

SEQ ID NO: 1077 - DNA, 17 bp, Artificial sequence
  Synthetic oligonucleotide
tctccattagatcatca

SEQ ID NO: 1078 - DNA, 17 bp, Artificial sequence
  Synthetic oligonucleotide
gagaaaataaagtatac

SEQ ID NO: 1079 - DNA, 17 bp, Artificial sequence
  Synthetic oligonucleotide
tggtccatgggtgcaat

SEQ ID NO: 1080 - DNA, 17 bp, Artificial sequence
  Synthetic oligonucleotide
atatgcaaattattctc

SEQ ID NO: 1081 - DNA, 17 bp, Artificial sequence
  Synthetic oligonucleotide
ttcccagcccaagttta

SEQ ID NO: 1082 - DNA, 17 bp, Artificial sequence
  Synthetic oligonucleotide
aataggtaactttatat

SEQ ID NO: 1083 - DNA, 17 bp, Artificial sequence
  Synthetic oligonucleotide
taatatatggttttgaa

SEQ ID NO: 1084 - DNA, 17 bp, Artificial sequence
  Synthetic oligonucleotide
ggattctgctttatttt

SEQ ID NO: 1085 - DNA, 17 bp, Artificial sequence
  Synthetic oligonucleotide
cgacacatttaaaaaca

SEQ ID NO: 1086 - DNA, 17 bp, Artificial sequence
  Synthetic oligonucleotide
aaagcgagattaaaaat

SEQ ID NO: 1087 - DNA, 17 bp, Artificial sequence
  Synthetic oligonucleotide
ggatatggctgatgtct

SEQ ID NO: 1088 - DNA, 17 bp, Artificial sequence
  Synthetic oligonucleotide
ccaatatttaaatggtg

SEQ ID NO: 1089 - DNA, 17 bp, Artificial sequence
  Synthetic oligonucleotide
gccaatatttacttatt

SEQ ID NO: 1090 - DNA, 17 bp, Artificial sequence
  Synthetic oligonucleotide
tcatgtggaatctaaag

SEQ ID NO: 1091 - DNA, 17 bp, Artificial sequence
  Synthetic oligonucleotide
agtatgaaaatgaagag

SEQ ID NO: 1092 - DNA, 17 bp, Artificial sequence
  Synthetic oligonucleotide
attcttgttgttcaggc

SEQ ID NO: 1093 - DNA, 17 bp, Artificial sequence
  Synthetic oligonucleotide
ggaatgtaaagccatga

SEQ ID NO: 1094 - DNA, 17 bp, Artificial sequence
  Synthetic oligonucleotide
attaaagggtggtagaa

SEQ ID NO: 1095 - DNA, 17 bp, Artificial sequence
  Synthetic oligonucleotide
aatgaaccgtaatctca

SEQ ID NO: 1096 - DNA, 17 bp, Artificial sequence
  Synthetic oligonucleotide
ctgggttaatgcctgaa

SEQ ID NO: 1097 - DNA, 17 bp, Artificial sequence
  Synthetic oligonucleotide
atctgggttaatgcctg

SEQ ID NO: 1098 - DNA, 17 bp, Artificial sequence
  Synthetic oligonucleotide
gaaatgtcactgttcct

SEQ ID NO: 1099 - DNA, 17 bp, Artificial sequence
  Synthetic oligonucleotide
ggttggtatgtatttta

SEQ ID NO: 1100 - DNA, 17 bp, Artificial sequence
  Synthetic oligonucleotide
caaggaggtcattgtgg

SEQ ID NO: 1101 - DNA, 17 bp, Artificial sequence
  Synthetic oligonucleotide
ctttggcaaagaaagga

SEQ ID NO: 1102 - DNA, 17 bp, Artificial sequence
  Synthetic oligonucleotide
aaatgaaagttgttgtg

SEQ ID NO: 1103 - DNA, 17 bp, Artificial sequence
  Synthetic oligonucleotide
gatatttttgttctgcc

SEQ ID NO: 1104 - DNA, 17 bp, Artificial sequence
  Synthetic oligonucleotide
gctataaatagaattaa

SEQ ID NO: 1105 - DNA, 17 bp, Artificial sequence
  Synthetic oligonucleotide
tagatttctgtttcctc

SEQ ID NO: 1106 - DNA, 17 bp, Artificial sequence
  Synthetic oligonucleotide
aatgcaggtgaataaaa

SEQ ID NO: 1107 - DNA, 17 bp, Artificial sequence
  Synthetic oligonucleotide
caatttctaggttctat

SEQ ID NO: 1108 - DNA, 17 bp, Artificial sequence
  Synthetic oligonucleotide
aactatgctgcaatttc

SEQ ID NO: 1109 - DNA, 17 bp, Artificial sequence
  Synthetic oligonucleotide
acaactatgctgcaatt

SEQ ID NO: 1110 - DNA, 17 bp, Artificial sequence
  Synthetic oligonucleotide
ttccacaactatgctgc

SEQ ID NO: 1111 - DNA, 17 bp, Artificial sequence
  Synthetic oligonucleotide
gaccacaattgcagaca

SEQ ID NO: 1112 - DNA, 17 bp, Artificial sequence
  Synthetic oligonucleotide
gtgtgagcaaacattct

SEQ ID NO: 1113 - DNA, 17 bp, Artificial sequence
  Synthetic oligonucleotide
cagtgtgagcaaacatt

SEQ ID NO: 1114 - DNA, 17 bp, Artificial sequence
  Synthetic oligonucleotide
cacagtgtgagcaaaca

SEQ ID NO: 1115 - DNA, 17 bp, Artificial sequence
  Synthetic oligonucleotide
ggcacagtgtgagcaaa

SEQ ID NO: 1116 - DNA, 17 bp, Artificial sequence
  Synthetic oligonucleotide
aagtttctggcacagtg

SEQ ID NO: 1117 - DNA, 17 bp, Artificial sequence
  Synthetic oligonucleotide
gttcagaattatgtcat

SEQ ID NO: 1118 - DNA, 17 bp, Artificial sequence
  Synthetic oligonucleotide
tcttatgtgcacatgag

SEQ ID NO: 1119 - DNA, 17 bp, Artificial sequence
  Synthetic oligonucleotide
catagtagcattacaga

SEQ ID NO: 1120 - DNA, 17 bp, Artificial sequence
  Synthetic oligonucleotide
tcaggcagtggcttcac

SEQ ID NO: 1121 - DNA, 17 bp, Artificial sequence
  Synthetic oligonucleotide
taaaaaaagttgttcat

SEQ ID NO: 1122 - DNA, 17 bp, Artificial sequence
  Synthetic oligonucleotide
cactcaagtgtttaaaa

SEQ ID NO: 1123 - DNA, 17 bp, Artificial sequence
  Synthetic oligonucleotide
tgtgacctgtgcttgtt

SEQ ID NO: 1124 - DNA, 17 bp, Artificial sequence
  Synthetic oligonucleotide
cctgtgacctgtgcttg

SEQ ID NO: 1125 - DNA, 17 bp, Artificial sequence
  Synthetic oligonucleotide
tgcctgtgacctgtgct

SEQ ID NO: 1126 - DNA, 17 bp, Artificial sequence
  Synthetic oligonucleotide
gttgcctgtgacctgtg

SEQ ID NO: 1127 - DNA, 17 bp, Artificial sequence
  Synthetic oligonucleotide
tattagacacttaaggg

SEQ ID NO: 1128 - DNA, 17 bp, Artificial sequence
  Synthetic oligonucleotide
tcaatcttaaatttttc

SEQ ID NO: 1129 - DNA, 17 bp, Artificial sequence
  Synthetic oligonucleotide
gtactttcccacctaga

SEQ ID NO: 1130 - DNA, 17 bp, Artificial sequence
  Synthetic oligonucleotide
tctcagagaccacagct

SEQ ID NO: 1131 - DNA, 17 bp, Artificial sequence
  Synthetic oligonucleotide
ttgttctcagagaccac

SEQ ID NO: 1132 - DNA, 17 bp, Artificial sequence
  Synthetic oligonucleotide
tattgttctcagagacc

SEQ ID NO: 1133 - DNA, 17 bp, Artificial sequence
  Synthetic oligonucleotide
catattgttctcagaga

SEQ ID NO: 1134 - DNA, 17 bp, Artificial sequence
  Synthetic oligonucleotide
actattaaccactgatc

SEQ ID NO: 1135 - DNA, 17 bp, Artificial sequence
  Synthetic oligonucleotide
gttgcagtccacagaat

SEQ ID NO: 1136 - DNA, 17 bp, Artificial sequence
  Synthetic oligonucleotide
taaagataagtatctca

SEQ ID NO: 1137 - DNA, 17 bp, Artificial sequence
  Synthetic oligonucleotide
aaaacaaacctaagtca

SEQ ID NO: 1138 - DNA, 17 bp, Artificial sequence
  Synthetic oligonucleotide
aaaagctaacagcctat

SEQ ID NO: 1139 - DNA, 17 bp, Artificial sequence
  Synthetic oligonucleotide
ttaaattgatgagatgt

SEQ ID NO: 1140 - DNA, 17 bp, Artificial sequence
  Synthetic oligonucleotide
gtattctttgcattagt

SEQ ID NO: 1141 - DNA, 17 bp, Artificial sequence
  Synthetic oligonucleotide
taaaagtgtacattatt

SEQ ID NO: 1142 - DNA, 17 bp, Artificial sequence
  Synthetic oligonucleotide
ctcaaggcaaagctgta

SEQ ID NO: 1143 - DNA, 17 bp, Artificial sequence
  Synthetic oligonucleotide
tgccactataagcagtc

SEQ ID NO: 1144 - DNA, 17 bp, Artificial sequence
  Synthetic oligonucleotide
ttcaagcccatgccctc

SEQ ID NO: 1145 - DNA, 17 bp, Artificial sequence
  Synthetic oligonucleotide
atccagtagagtgagag

SEQ ID NO: 1146 - DNA, 17 bp, Artificial sequence
  Synthetic oligonucleotide
tcatccagtagagtgag

SEQ ID NO: 1147 - DNA, 17 bp, Artificial sequence
  Synthetic oligonucleotide
gacatcatccagtagag

SEQ ID NO: 1148 - DNA, 17 bp, Artificial sequence
  Synthetic oligonucleotide
tgaatacattgtcttaa

SEQ ID NO: 1149 - DNA, 17 bp, Artificial sequence
  Synthetic oligonucleotide
attgaatacattgtctt

SEQ ID NO: 1150 - DNA, 17 bp, Artificial sequence
  Synthetic oligonucleotide
taattgaatacattgtc

SEQ ID NO: 1151 - DNA, 17 bp, Artificial sequence
  Synthetic oligonucleotide
cataattgaatacattg

SEQ ID NO: 1152 - DNA, 17 bp, Artificial sequence
  Synthetic oligonucleotide
tgagtagctatggttta

SEQ ID NO: 1153 - DNA, 17 bp, Artificial sequence
  Synthetic oligonucleotide
tctttgtgttatacaat

SEQ ID NO: 1154 - DNA, 17 bp, Artificial sequence
  Synthetic oligonucleotide
cctctttgtgttataca

SEQ ID NO: 1155 - DNA, 17 bp, Artificial sequence
  Synthetic oligonucleotide
tccctctttgtgttata

SEQ ID NO: 1156 - DNA, 17 bp, Artificial sequence
  Synthetic oligonucleotide
tttccctctttgtgtta

SEQ ID NO: 1157 - DNA, 17 bp, Artificial sequence
  Synthetic oligonucleotide
tacatacaatattaagg

SEQ ID NO: 1158 - DNA, 17 bp, Artificial sequence
  Synthetic oligonucleotide
aaaagaatggattctga

SEQ ID NO: 1159 - DNA, 17 bp, Artificial sequence
  Synthetic oligonucleotide
aaggaaaaactctgccc

SEQ ID NO: 1160 - DNA, 17 bp, Artificial sequence
  Synthetic oligonucleotide
tcaccccaaggcatttg

SEQ ID NO: 1161 - DNA, 17 bp, Artificial sequence
  Synthetic oligonucleotide
acaccctgattcccaag

SEQ ID NO: 1162 - DNA, 17 bp, Artificial sequence
  Synthetic oligonucleotide
gtgtgagcaaacattca

SEQ ID NO: 1163 - DNA, 17 bp, Artificial sequence
  Synthetic oligonucleotide
gtcacagtgtgagcaaa

SEQ ID NO: 1164 - DNA, 17 bp, Artificial sequence
  Synthetic oligonucleotide
gggaagtattagtggaa

SEQ ID NO: 1165 - DNA, 17 bp, Artificial sequence
  Synthetic oligonucleotide
gctgaaaatatgaaaca

SEQ ID NO: 1166 - DNA, 17 bp, Artificial sequence
  Synthetic oligonucleotide
acttctagcactatttt

SEQ ID NO: 1167 - DNA, 17 bp, Artificial sequence
  Synthetic oligonucleotide
ttgtgcatttattccac

SEQ ID NO: 1168 - DNA, 17 bp, Artificial sequence
  Synthetic oligonucleotide
gactgtaatctaggacc

SEQ ID NO: 1169 - DNA, 17 bp, Artificial sequence
  Synthetic oligonucleotide
tgacttttgaatcagtc

SEQ ID NO: 1170 - DNA, 17 bp, Artificial sequence
  Synthetic oligonucleotide
gagcgattctcctggtt

SEQ ID NO: 1171 - DNA, 17 bp, Artificial sequence
  Synthetic oligonucleotide
cacagtccataatattg

SEQ ID NO: 1172 - DNA, 17 bp, Artificial sequence
  Synthetic oligonucleotide
tttttgttaatagttct

SEQ ID NO: 1173 - DNA, 17 bp, Artificial sequence
  Synthetic oligonucleotide
gctttctcagagcccaa

SEQ ID NO: 1174 - DNA, 17 bp, Artificial sequence
  Synthetic oligonucleotide
atctctctaccatgtga

SEQ ID NO: 1175 - DNA, 17 bp, Artificial sequence
  Synthetic oligonucleotide
gtggataaagtacatta

SEQ ID NO: 1176 - DNA, 17 bp, Artificial sequence
  Synthetic oligonucleotide
aaatggtattcagagat

SEQ ID NO: 1177 - DNA, 17 bp, Artificial sequence
  Synthetic oligonucleotide
ttttctcctaaagcctt

SEQ ID NO: 1178 - DNA, 17 bp, Artificial sequence
  Synthetic oligonucleotide
cagatttccagcacact

SEQ ID NO: 1179 - DNA, 17 bp, Artificial sequence
  Synthetic oligonucleotide
ccttcttagtggtaaga

SEQ ID NO: 1180 - DNA, 17 bp, Artificial sequence
  Synthetic oligonucleotide
aattacagtgtaggtaa

SEQ ID NO: 1181 - DNA, 17 bp, Artificial sequence
  Synthetic oligonucleotide
ataagaggtcactggat

SEQ ID NO: 1182 - DNA, 17 bp, Artificial sequence
  Synthetic oligonucleotide
aaggaaacagtctacat

SEQ ID NO: 1183 - DNA, 17 bp, Artificial sequence
  Synthetic oligonucleotide
ctatcatgataagtata

SEQ ID NO: 1184 - DNA, 17 bp, Artificial sequence
  Synthetic oligonucleotide
tgtggttctgcccatct

SEQ ID NO: 1185 - DNA, 17 bp, Artificial sequence
  Synthetic oligonucleotide
gcctaaacattttactt

SEQ ID NO: 1186 - DNA, 17 bp, Artificial sequence
  Synthetic oligonucleotide
gaagtttctgaagaaat

SEQ ID NO: 1187 - DNA, 17 bp, Artificial sequence
  Synthetic oligonucleotide
ttttcagtagatttgac

SEQ ID NO: 1188 - DNA, 17 bp, Artificial sequence
  Synthetic oligonucleotide
gctatgaccctcaagcc

SEQ ID NO: 1189 - DNA, 17 bp, Artificial sequence
  Synthetic oligonucleotide
aatagagcaaaatttcg

SEQ ID NO: 1190 - DNA, 17 bp, Artificial sequence
  Synthetic oligonucleotide
ataatcaaacaaaaggg

SEQ ID NO: 1191 - DNA, 17 bp, Artificial sequence
  Synthetic oligonucleotide
aaagttcaatgctgtgt

SEQ ID NO: 1192 - DNA, 17 bp, Artificial sequence
  Synthetic oligonucleotide
gaaatgggcatgtaaac

SEQ ID NO: 1193 - DNA, 17 bp, Artificial sequence
  Synthetic oligonucleotide
caaaatacaatgttcaa

SEQ ID NO: 1194 - DNA, 17 bp, Artificial sequence
  Synthetic oligonucleotide
attcttctatcctagaa

SEQ ID NO: 1195 - DNA, 17 bp, Artificial sequence
  Synthetic oligonucleotide
attatcatggttgccca

SEQ ID NO: 1196 - DNA, 17 bp, Artificial sequence
  Synthetic oligonucleotide
atgagatctttttgcat

SEQ ID NO: 1197 - DNA, 17 bp, Artificial sequence
  Synthetic oligonucleotide
aagcaagttgtccatgg

SEQ ID NO: 1198 - DNA, 17 bp, Artificial sequence
  Synthetic oligonucleotide
tgttggagtttacaatt

SEQ ID NO: 1199 - DNA, 17 bp, Artificial sequence
  Synthetic oligonucleotide
ctcactagccctgtgac

SEQ ID NO: 1200 - DNA, 17 bp, Artificial sequence
  Synthetic oligonucleotide
tctctttcatgggtatt

SEQ ID NO: 1201 - DNA, 17 bp, Artificial sequence
  Synthetic oligonucleotide
gtcattttaataagtgt

SEQ ID NO: 1202 - DNA, 17 bp, Artificial sequence
  Synthetic oligonucleotide
caattaaataaacctct

SEQ ID NO: 1203 - DNA, 17 bp, Artificial sequence
  Synthetic oligonucleotide
tatggtgatatggttag

SEQ ID NO: 1204 - DNA, 17 bp, Artificial sequence
  Synthetic oligonucleotide
ccatgtgtttttgtggc

SEQ ID NO: 1205 - DNA, 17 bp, Artificial sequence
  Synthetic oligonucleotide
caaaggtataaggtcat

SEQ ID NO: 1206 - DNA, 17 bp, Artificial sequence
  Synthetic oligonucleotide
agcttgtatttttgaaa

SEQ ID NO: 1207 - DNA, 17 bp, Artificial sequence
  Synthetic oligonucleotide
cgcatctgtctttcttt

SEQ ID NO: 1208 - DNA, 17 bp, Artificial sequence
  Synthetic oligonucleotide
taggacaggtgaaataa

SEQ ID NO: 1209 - DNA, 17 bp, Artificial sequence
  Synthetic oligonucleotide
agttattagaataacac

SEQ ID NO: 1210 - DNA, 17 bp, Artificial sequence
  Synthetic oligonucleotide
aataaaatgtcttaatc

SEQ ID NO: 1211 - DNA, 17 bp, Artificial sequence
  Synthetic oligonucleotide
actcaaaaaagaagaat

SEQ ID NO: 1212 - DNA, 17 bp, Artificial sequence
  Synthetic oligonucleotide
gttttctctgtattggc

SEQ ID NO: 1213 - DNA, 17 bp, Artificial sequence
  Synthetic oligonucleotide
tggcctagtggttataa

SEQ ID NO: 1214 - DNA, 17 bp, Artificial sequence
  Synthetic oligonucleotide
cacaaagaggaaacagg

SEQ ID NO: 1215 - DNA, 17 bp, Artificial sequence
  Synthetic oligonucleotide
acattttttaactggat

SEQ ID NO: 1216 - DNA, 17 bp, Artificial sequence
  Synthetic oligonucleotide
aggctaaattttaataa

SEQ ID NO: 1217 - DNA, 17 bp, Artificial sequence
  Synthetic oligonucleotide
tagcctttcatagtacg

SEQ ID NO: 1218 - DNA, 17 bp, Artificial sequence
  Synthetic oligonucleotide
aagaggaaaagcttgga

SEQ ID NO: 1219 - DNA, 17 bp, Artificial sequence
  Synthetic oligonucleotide
aaaaattctggtgccaa

SEQ ID NO: 1220 - DNA, 17 bp, Artificial sequence
  Synthetic oligonucleotide
aagctaaactaccgctg

SEQ ID NO: 1221 - DNA, 17 bp, Artificial sequence
  Synthetic oligonucleotide
gaatttcctggatgctc

SEQ ID NO: 1222 - DNA, 17 bp, Artificial sequence
  Synthetic oligonucleotide
agattccagcagagatt

SEQ ID NO: 1223 - DNA, 17 bp, Artificial sequence
  Synthetic oligonucleotide
acagattccagcagaga

SEQ ID NO: 1224 - DNA, 17 bp, Artificial sequence
  Synthetic oligonucleotide
gaacagattccagcaga

SEQ ID NO: 1225 - DNA, 17 bp, Artificial sequence
  Synthetic oligonucleotide
gtgaacagattccagca

SEQ ID NO: 1226 - DNA, 17 bp, Artificial sequence
  Synthetic oligonucleotide
atctgtaagaagtttag

SEQ ID NO: 1227 - DNA, 17 bp, Artificial sequence
  Synthetic oligonucleotide
tgagaaattttatgggt

SEQ ID NO: 1228 - DNA, 17 bp, Artificial sequence
  Synthetic oligonucleotide
tcattcaaaaccatcct

SEQ ID NO: 1229 - DNA, 17 bp, Artificial sequence
  Synthetic oligonucleotide
gatcacactgcttatag

SEQ ID NO: 1230 - DNA, 17 bp, Artificial sequence
  Synthetic oligonucleotide
caagttgatggcatata

SEQ ID NO: 1231 - DNA, 17 bp, Artificial sequence
  Synthetic oligonucleotide
gtgtaccaacctcaagt

SEQ ID NO: 1232 - DNA, 17 bp, Artificial sequence
  Synthetic oligonucleotide
taagtaaatacctaggg

SEQ ID NO: 1233 - DNA, 17 bp, Artificial sequence
  Synthetic oligonucleotide
gatttgtgcctggcatc

SEQ ID NO: 1234 - DNA, 17 bp, Artificial sequence
  Synthetic oligonucleotide
tgcctctacctccagca

SEQ ID NO: 1235 - DNA, 17 bp, Artificial sequence
  Synthetic oligonucleotide
gatgcctctacctccag

SEQ ID NO: 1236 - DNA, 17 bp, Artificial sequence
  Synthetic oligonucleotide
ctgatgcctctacctcc

SEQ ID NO: 1237 - DNA, 17 bp, Artificial sequence
  Synthetic oligonucleotide
tatcacaactacattgt

SEQ ID NO: 1238 - DNA, 17 bp, Artificial sequence
  Synthetic oligonucleotide
ggcctcctgctgcagca

SEQ ID NO: 1239 - DNA, 17 bp, Artificial sequence
  Synthetic oligonucleotide
gcactcattttaaatgt

SEQ ID NO: 1240 - DNA, 17 bp, Artificial sequence
  Synthetic oligonucleotide
tggtaacttaggacaag

SEQ ID NO: 1241 - DNA, 17 bp, Artificial sequence
  Synthetic oligonucleotide
ttctctggacctcttaa

SEQ ID NO: 1242 - DNA, 17 bp, Artificial sequence
  Synthetic oligonucleotide
acttctctggacctctt

SEQ ID NO: 1243 - DNA, 17 bp, Artificial sequence
  Synthetic oligonucleotide
ttacttctctggacctc

SEQ ID NO: 1244 - DNA, 17 bp, Artificial sequence
  Synthetic oligonucleotide
tcaatacaacttaattc

SEQ ID NO: 1245 - DNA, 17 bp, Artificial sequence
  Synthetic oligonucleotide
ttgggctggaagcagtg

SEQ ID NO: 1246 - DNA, 17 bp, Artificial sequence
  Synthetic oligonucleotide
aagatatgcagagggtt

SEQ ID NO: 1247 - DNA, 17 bp, Artificial sequence
  Synthetic oligonucleotide
tggtctaactgtgttgc

SEQ ID NO: 1248 - DNA, 17 bp, Artificial sequence
  Synthetic oligonucleotide
gtttatggactttttaa

SEQ ID NO: 1249 - DNA, 17 bp, Artificial sequence
  Synthetic oligonucleotide
ttttgtactttatggaa

SEQ ID NO: 1250 - DNA, 17 bp, Artificial sequence
  Synthetic oligonucleotide
acttctccttcaattaa

SEQ ID NO: 1251 - DNA, 17 bp, Artificial sequence
  Synthetic oligonucleotide
aaaatttttgcacactt

SEQ ID NO: 1252 - DNA, 17 bp, Artificial sequence
  Synthetic oligonucleotide
gccaaatcaatggatga

SEQ ID NO: 1253 - DNA, 17 bp, Artificial sequence
  Synthetic oligonucleotide
agtgaccaagagaatga

SEQ ID NO: 1254 - DNA, 17 bp, Artificial sequence
  Synthetic oligonucleotide
ttttaaaacactggcct

SEQ ID NO: 1255 - DNA, 17 bp, Artificial sequence
  Synthetic oligonucleotide
taggattaaacagtcca

SEQ ID NO: 1256 - DNA, 17 bp, Artificial sequence
  Synthetic oligonucleotide
ttatctgttgctatgtg

SEQ ID NO: 1257 - DNA, 17 bp, Artificial sequence
  Synthetic oligonucleotide
aagaaggagaatagcag

SEQ ID NO: 1258 - DNA, 17 bp, Artificial sequence
  Synthetic oligonucleotide
cgggcaaacatgttttg

SEQ ID NO: 1259 - DNA, 17 bp, Artificial sequence
  Synthetic oligonucleotide
atgacctacatgctaaa

SEQ ID NO: 1260 - DNA, 17 bp, Artificial sequence
  Synthetic oligonucleotide
agaagcaaaatgtcagt

SEQ ID NO: 1261 - DNA, 17 bp, Artificial sequence
  Synthetic oligonucleotide
cctaacagctttacttt

SEQ ID NO: 1262 - DNA, 17 bp, Artificial sequence
  Synthetic oligonucleotide
ctttcacacatctctaa

SEQ ID NO: 1263 - DNA, 17 bp, Artificial sequence
  Synthetic oligonucleotide
tttcattaatctgtgaa

SEQ ID NO: 1264 - DNA, 17 bp, Artificial sequence
  Synthetic oligonucleotide
tatttcattaatctgtg

SEQ ID NO: 1265 - DNA, 17 bp, Artificial sequence
  Synthetic oligonucleotide
tatatttcattaatctg

SEQ ID NO: 1266 - DNA, 17 bp, Artificial sequence
  Synthetic oligonucleotide
ccttacacaaaatataa

SEQ ID NO: 1267 - DNA, 17 bp, Artificial sequence
  Synthetic oligonucleotide
acaccaatatattattt

SEQ ID NO: 1268 - DNA, 17 bp, Artificial sequence
  Synthetic oligonucleotide
taaaggatgcaaaggca

SEQ ID NO: 1269 - DNA, 17 bp, Artificial sequence
  Synthetic oligonucleotide
ttccagcgatcccactc

SEQ ID NO: 1270 - DNA, 17 bp, Artificial sequence
  Synthetic oligonucleotide
ctcaacatctttaatga

SEQ ID NO: 1271 - DNA, 17 bp, Artificial sequence
  Synthetic oligonucleotide
gggacctaaaactataa

SEQ ID NO: 1272 - DNA, 17 bp, Artificial sequence
  Synthetic oligonucleotide
agcagaatagaaaatcc

SEQ ID NO: 1273 - DNA, 17 bp, Artificial sequence
  Synthetic oligonucleotide
ttcaatgcgactcccat

SEQ ID NO: 1274 - DNA, 17 bp, Artificial sequence
  Synthetic oligonucleotide
caacaaaactgagaatc

SEQ ID NO: 1275 - DNA, 17 bp, Artificial sequence
  Synthetic oligonucleotide
aatgcctgctttcacca

SEQ ID NO: 1276 - DNA, 17 bp, Artificial sequence
  Synthetic oligonucleotide
tataagcaggagtaaaa

SEQ ID NO: 1277 - DNA, 17 bp, Artificial sequence
  Synthetic oligonucleotide
gttccaaaagatagaga

SEQ ID NO: 1278 - DNA, 17 bp, Artificial sequence
  Synthetic oligonucleotide
cgtacacaaactagaaa

SEQ ID NO: 1279 - DNA, 17 bp, Artificial sequence
  Synthetic oligonucleotide
tactgttgcattccagc

SEQ ID NO: 1280 - DNA, 17 bp, Artificial sequence
  Synthetic oligonucleotide
tcttagtgtggtggctc

SEQ ID NO: 1281 - DNA, 17 bp, Artificial sequence
  Synthetic oligonucleotide
tcaacaataataatgac

SEQ ID NO: 1282 - DNA, 17 bp, Artificial sequence
  Synthetic oligonucleotide
ccttttcatcaacacat

SEQ ID NO: 1283 - DNA, 17 bp, Artificial sequence
  Synthetic oligonucleotide
tatgcatctaacacttg

SEQ ID NO: 1284 - DNA, 17 bp, Artificial sequence
  Synthetic oligonucleotide
ccatcaaccaagtatct

SEQ ID NO: 1285 - DNA, 17 bp, Artificial sequence
  Synthetic oligonucleotide
cttgaaacagtaacttg

SEQ ID NO: 1286 - DNA, 17 bp, Artificial sequence
  Synthetic oligonucleotide
aacatagcagattaata

SEQ ID NO: 1287 - DNA, 17 bp, Artificial sequence
  Synthetic oligonucleotide
tcatgttatatagtggg

SEQ ID NO: 1288 - DNA, 17 bp, Artificial sequence
  Synthetic oligonucleotide
tgtaacctaatgtaaat

SEQ ID NO: 1289 - DNA, 17 bp, Artificial sequence
  Synthetic oligonucleotide
acaagtatctgtactca

SEQ ID NO: 1290 - DNA, 17 bp, Artificial sequence
  Synthetic oligonucleotide
gtctctgttaatgttgg

SEQ ID NO: 1291 - DNA, 17 bp, Artificial sequence
  Synthetic oligonucleotide
gaaccagcctgacttaa

SEQ ID NO: 1292 - DNA, 17 bp, Artificial sequence
  Synthetic oligonucleotide
ttgtatgggttacataa

SEQ ID NO: 1293 - DNA, 17 bp, Artificial sequence
  Synthetic oligonucleotide
caattaaatgcaattcc

SEQ ID NO: 1294 - DNA, 17 bp, Artificial sequence
  Synthetic oligonucleotide
tgacagaagtgtgcata

SEQ ID NO: 1295 - DNA, 17 bp, Artificial sequence
  Synthetic oligonucleotide
caacacatccacattgc

SEQ ID NO: 1296 - DNA, 17 bp, Artificial sequence
  Synthetic oligonucleotide
ttcacacctctctccct

SEQ ID NO: 1297 - DNA, 17 bp, Artificial sequence
  Synthetic oligonucleotide
tgctggtctaagatgca

SEQ ID NO: 1298 - DNA, 17 bp, Artificial sequence
  Synthetic oligonucleotide
atgtgttttgaggaaaa

SEQ ID NO: 1299 - DNA, 17 bp, Artificial sequence
  Synthetic oligonucleotide
cagaagtaaatgtggac

SEQ ID NO: 1300 - DNA, 17 bp, Artificial sequence
  Synthetic oligonucleotide
tgattctttggattcat

SEQ ID NO: 1301 - DNA, 17 bp, Artificial sequence
  Synthetic oligonucleotide
cattcttgtttttattc

SEQ ID NO: 1302 - DNA, 17 bp, Artificial sequence
  Synthetic oligonucleotide
aatagtgtcccagtgta

SEQ ID NO: 1303 - DNA, 17 bp, Artificial sequence
  Synthetic oligonucleotide
tgaaagctgttcagtta

SEQ ID NO: 1304 - DNA, 17 bp, Artificial sequence
  Synthetic oligonucleotide
cccacatatactacttg

SEQ ID NO: 1305 - DNA, 17 bp, Artificial sequence
  Synthetic oligonucleotide
agaatttcaggaagtta

SEQ ID NO: 1306 - DNA, 17 bp, Artificial sequence
  Synthetic oligonucleotide
caaagtaagaggagatt

SEQ ID NO: 1307 - DNA, 17 bp, Artificial sequence
  Synthetic oligonucleotide
gccaaagtaagaggaga

SEQ ID NO: 1308 - DNA, 17 bp, Artificial sequence
  Synthetic oligonucleotide
cagtgccaaagtaagag

SEQ ID NO: 1309 - DNA, 17 bp, Artificial sequence
  Synthetic oligonucleotide
tgaatccatttgtccag

SEQ ID NO: 1310 - DNA, 17 bp, Artificial sequence
  Synthetic oligonucleotide
ctctaaaatacaaatgt

SEQ ID NO: 1311 - DNA, 17 bp, Artificial sequence
  Synthetic oligonucleotide
gaacaaaggaataagta

SEQ ID NO: 1312 - DNA, 17 bp, Artificial sequence
  Synthetic oligonucleotide
ctagatgtagatatcat

SEQ ID NO: 1313 - DNA, 17 bp, Artificial sequence
  Synthetic oligonucleotide
aagggaataaattgtag

SEQ ID NO: 1314 - DNA, 17 bp, Artificial sequence
  Synthetic oligonucleotide
caacagaccctttcaat

SEQ ID NO: 1315 - DNA, 17 bp, Artificial sequence
  Synthetic oligonucleotide
gtcttcccactgcctac

SEQ ID NO: 1316 - DNA, 17 bp, Artificial sequence
  Synthetic oligonucleotide
tttagatatacctccaa

SEQ ID NO: 1317 - DNA, 17 bp, Artificial sequence
  Synthetic oligonucleotide
gcttcagtttcttgagt

SEQ ID NO: 1318 - DNA, 17 bp, Artificial sequence
  Synthetic oligonucleotide
ctggtctttctcacaat

SEQ ID NO: 1319 - DNA, 17 bp, Artificial sequence
  Synthetic oligonucleotide
atcattcttaacagaaa

SEQ ID NO: 1320 - DNA, 17 bp, Artificial sequence
  Synthetic oligonucleotide
gctcttgctgtgcagcc

SEQ ID NO: 1321 - DNA, 17 bp, Artificial sequence
  Synthetic oligonucleotide
atttaaagcagcagtcc

SEQ ID NO: 1322 - DNA, 17 bp, Artificial sequence
  Synthetic oligonucleotide
aggtaattctaatttta

SEQ ID NO: 1323 - DNA, 17 bp, Artificial sequence
  Synthetic oligonucleotide
ggcaaatgacagggtct

SEQ ID NO: 1324 - DNA, 17 bp, Artificial sequence
  Synthetic oligonucleotide
tctcaactgcctgagta

SEQ ID NO: 1325 - DNA, 17 bp, Artificial sequence
  Synthetic oligonucleotide
catgtcagctttttagt

SEQ ID NO: 1326 - DNA, 17 bp, Artificial sequence
  Synthetic oligonucleotide
atactcagatatttaaa

SEQ ID NO: 1327 - DNA, 17 bp, Artificial sequence
  Synthetic oligonucleotide
actttctgtgtggtatg

SEQ ID NO: 1328 - DNA, 17 bp, Artificial sequence
  Synthetic oligonucleotide
agactttctgtgtggta

SEQ ID NO: 1329 - DNA, 17 bp, Artificial sequence
  Synthetic oligonucleotide
acagactttctgtgtgg

SEQ ID NO: 1330 - DNA, 17 bp, Artificial sequence
  Synthetic oligonucleotide
agacagactttctgtgt

SEQ ID NO: 1331 - DNA, 17 bp, Artificial sequence
  Synthetic oligonucleotide
gttgagaatttttcatt

SEQ ID NO: 1332 - DNA, 17 bp, Artificial sequence
  Synthetic oligonucleotide
agttatggagcatcttt

SEQ ID NO: 1333 - DNA, 17 bp, Artificial sequence
  Synthetic oligonucleotide
gactgagttttttattc

SEQ ID NO: 1334 - DNA, 17 bp, Artificial sequence
  Synthetic oligonucleotide
tcctgaattaaaaattt

SEQ ID NO: 1335 - DNA, 17 bp, Artificial sequence
  Synthetic oligonucleotide
gctaagcacaaacaatt

SEQ ID NO: 1336 - DNA, 17 bp, Artificial sequence
  Synthetic oligonucleotide
gaactctgtagtcagaa

SEQ ID NO: 1337 - DNA, 17 bp, Artificial sequence
  Synthetic oligonucleotide
tagaactctgtagtcag

SEQ ID NO: 1338 - DNA, 17 bp, Artificial sequence
  Synthetic oligonucleotide
aatagaactctgtagtc

SEQ ID NO: 1339 - DNA, 17 bp, Artificial sequence
  Synthetic oligonucleotide
tgaatagaactctgtag

SEQ ID NO: 1340 - DNA, 17 bp, Artificial sequence
  Synthetic oligonucleotide
acacagagcacttctta

SEQ ID NO: 1341 - DNA, 17 bp, Artificial sequence
  Synthetic oligonucleotide
ggagttacagagttgcc

SEQ ID NO: 1342 - DNA, 17 bp, Artificial sequence
  Synthetic oligonucleotide
tatcagtctattaagaa

SEQ ID NO: 1343 - DNA, 17 bp, Artificial sequence
  Synthetic oligonucleotide
aagtttctcagagcctg

SEQ ID NO: 1344 - DNA, 17 bp, Artificial sequence
  Synthetic oligonucleotide
aatacagaagtctattc

SEQ ID NO: 1345 - DNA, 17 bp, Artificial sequence
  Synthetic oligonucleotide
cattgaataaaaatttg

SEQ ID NO: 1346 - DNA, 17 bp, Artificial sequence
  Synthetic oligonucleotide
caggtataaaatttttt

SEQ ID NO: 1347 - DNA, 17 bp, Artificial sequence
  Synthetic oligonucleotide
ggtgttaatcacttgaa

SEQ ID NO: 1348 - DNA, 17 bp, Artificial sequence
  Synthetic oligonucleotide
tcttgaagctagttggg

SEQ ID NO: 1349 - DNA, 17 bp, Artificial sequence
  Synthetic oligonucleotide
agggcaactaaccaaca

SEQ ID NO: 1350 - DNA, 17 bp, Artificial sequence
  Synthetic oligonucleotide
gtggatacttagtatca

SEQ ID NO: 1351 - DNA, 17 bp, Artificial sequence
  Synthetic oligonucleotide
ctctctcagttgtaggt

SEQ ID NO: 1352 - DNA, 17 bp, Artificial sequence
  Synthetic oligonucleotide
aaagtatgctgtgttct

SEQ ID NO: 1353 - DNA, 17 bp, Artificial sequence
  Synthetic oligonucleotide
gtacccggcacttttcc

SEQ ID NO: 1354 - DNA, 17 bp, Artificial sequence
  Synthetic oligonucleotide
tctagaaaagctctctt

SEQ ID NO: 1355 - DNA, 17 bp, Artificial sequence
  Synthetic oligonucleotide
actctagaaaagctctc

SEQ ID NO: 1356 - DNA, 17 bp, Artificial sequence
  Synthetic oligonucleotide
agactctagaaaagctc

SEQ ID NO: 1357 - DNA, 17 bp, Artificial sequence
  Synthetic oligonucleotide
tggcacccaggagtaag

SEQ ID NO: 1358 - DNA, 17 bp, Artificial sequence
  Synthetic oligonucleotide
catacacaaaatcccct

SEQ ID NO: 1359 - DNA, 17 bp, Artificial sequence
  Synthetic oligonucleotide
cacatgaagccagggac

SEQ ID NO: 1360 - DNA, 17 bp, Artificial sequence
  Synthetic oligonucleotide
gcaggccctaaactgtg

SEQ ID NO: 1361 - DNA, 17 bp, Artificial sequence
  Synthetic oligonucleotide
aaatttatctatcatgc

SEQ ID NO: 1362 - DNA, 17 bp, Artificial sequence
  Synthetic oligonucleotide
gctaaacactttatcaa

SEQ ID NO: 1363 - DNA, 17 bp, Artificial sequence
  Synthetic oligonucleotide
acttcattctttctgtt

SEQ ID NO: 1364 - DNA, 17 bp, Artificial sequence
  Synthetic oligonucleotide
caattaaaagattactt

SEQ ID NO: 1365 - DNA, 17 bp, Artificial sequence
  Synthetic oligonucleotide
acattgtacagttaatt

SEQ ID NO: 1366 - DNA, 17 bp, Artificial sequence
  Synthetic oligonucleotide
tacaaaccttactatgc

SEQ ID NO: 1367 - DNA, 17 bp, Artificial sequence
  Synthetic oligonucleotide
aacagacttaaacaaac

SEQ ID NO: 1368 - DNA, 17 bp, Artificial sequence
  Synthetic oligonucleotide
ctcagacatcatgtttt

SEQ ID NO: 1369 - DNA, 17 bp, Artificial sequence
  Synthetic oligonucleotide
aggcactcacaaacatt

SEQ ID NO: 1370 - DNA, 17 bp, Artificial sequence
  Synthetic oligonucleotide
tctcgcatcctaaatgt

SEQ ID NO: 1371 - DNA, 17 bp, Artificial sequence
  Synthetic oligonucleotide
ttcatattttatgttac

SEQ ID NO: 1372 - DNA, 17 bp, Artificial sequence
  Synthetic oligonucleotide
tgaaattttccagctaa

SEQ ID NO: 1373 - DNA, 17 bp, Artificial sequence
  Synthetic oligonucleotide
cttgaaattttccagct

SEQ ID NO: 1374 - DNA, 17 bp, Artificial sequence
  Synthetic oligonucleotide
atcttgaaattttccag

SEQ ID NO: 1375 - DNA, 17 bp, Artificial sequence
  Synthetic oligonucleotide
ctataattacattccta

SEQ ID NO: 1376 - DNA, 17 bp, Artificial sequence
  Synthetic oligonucleotide
gcatgaacctagatatg

SEQ ID NO: 1377 - DNA, 17 bp, Artificial sequence
  Synthetic oligonucleotide
gctgtttgaagtgacaa

SEQ ID NO: 1378 - DNA, 17 bp, Artificial sequence
  Synthetic oligonucleotide
gagctgtttgaagtgac

SEQ ID NO: 1379 - DNA, 17 bp, Artificial sequence
  Synthetic oligonucleotide
gagagctgtttgaagtg

SEQ ID NO: 1380 - DNA, 17 bp, Artificial sequence
  Synthetic oligonucleotide
tggagagctgtttgaag

SEQ ID NO: 1381 - DNA, 17 bp, Artificial sequence
  Synthetic oligonucleotide
ctgccactattcacaat

SEQ ID NO: 1382 - DNA, 17 bp, Artificial sequence
  Synthetic oligonucleotide
ttattgcattaatggaa

SEQ ID NO: 1383 - DNA, 17 bp, Artificial sequence
  Synthetic oligonucleotide
atggtgttagctaggat

SEQ ID NO: 1384 - DNA, 17 bp, Artificial sequence
  Synthetic oligonucleotide
gtctttttacattataa

SEQ ID NO: 1385 - DNA, 17 bp, Artificial sequence
  Synthetic oligonucleotide
ataaccactattcaatg

SEQ ID NO: 1386 - DNA, 17 bp, Artificial sequence
  Synthetic oligonucleotide
aaaaatcacatttggca

SEQ ID NO: 1387 - DNA, 17 bp, Artificial sequence
  Synthetic oligonucleotide
ttctttcaccttatgag

SEQ ID NO: 1388 - DNA, 17 bp, Artificial sequence
  Synthetic oligonucleotide
atatatgtgtcagttct

SEQ ID NO: 1389 - DNA, 17 bp, Artificial sequence
  Synthetic oligonucleotide
gtgtcactttttaaggt

SEQ ID NO: 1390 - DNA, 17 bp, Artificial sequence
  Synthetic oligonucleotide
agaacaatgtcatcttt

SEQ ID NO: 1391 - DNA, 17 bp, Artificial sequence
  Synthetic oligonucleotide
aaagaacaatgtcatct

SEQ ID NO: 1392 - DNA, 17 bp, Artificial sequence
  Synthetic oligonucleotide
ggaaagaacaatgtcat

SEQ ID NO: 1393 - DNA, 17 bp, Artificial sequence
  Synthetic oligonucleotide
caggaaagaacaatgtc

SEQ ID NO: 1394 - DNA, 17 bp, Artificial sequence
  Synthetic oligonucleotide
cacaggtatacacactt

SEQ ID NO: 1395 - DNA, 17 bp, Artificial sequence
  Synthetic oligonucleotide
gtacaaaatctgcatat

SEQ ID NO: 1396 - DNA, 17 bp, Artificial sequence
  Synthetic oligonucleotide
ataggtattttatgcat

SEQ ID NO: 1397 - DNA, 17 bp, Artificial sequence
  Synthetic oligonucleotide
caaattatgcatttgtt

SEQ ID NO: 1398 - DNA, 17 bp, Artificial sequence
  Synthetic oligonucleotide
ctacaaaattgctaaaa

SEQ ID NO: 1399 - DNA, 17 bp, Artificial sequence
  Synthetic oligonucleotide
acaatgttactttgtcc

SEQ ID NO: 1400 - DNA, 17 bp, Artificial sequence
  Synthetic oligonucleotide
tacaaaaataccccccc

SEQ ID NO: 1401 - DNA, 17 bp, Artificial sequence
  Synthetic oligonucleotide
atttgtagacctatgtt

SEQ ID NO: 1402 - DNA, 17 bp, Artificial sequence
  Synthetic oligonucleotide
aagcatctcctgtggtg

SEQ ID NO: 1403 - DNA, 17 bp, Artificial sequence
  Synthetic oligonucleotide
caacatgttttatcatg

SEQ ID NO: 1404 - DNA, 17 bp, Artificial sequence
  Synthetic oligonucleotide
aatatgaccacaatttt

SEQ ID NO: 1405 - DNA, 17 bp, Artificial sequence
  Synthetic oligonucleotide
tggcaatatgaatgtgc

SEQ ID NO: 1406 - DNA, 17 bp, Artificial sequence
  Synthetic oligonucleotide
gataagggcacattgtc

SEQ ID NO: 1407 - DNA, 17 bp, Artificial sequence
  Synthetic oligonucleotide
gtgatggagggaaatcg

SEQ ID NO: 1408 - DNA, 17 bp, Artificial sequence
  Synthetic oligonucleotide
tgtggtaattggaacaa

SEQ ID NO: 1409 - DNA, 17 bp, Artificial sequence
  Synthetic oligonucleotide
actgaacccaaatggct

SEQ ID NO: 1410 - DNA, 17 bp, Artificial sequence
  Synthetic oligonucleotide
tcacattcatcatattc

SEQ ID NO: 1411 - DNA, 17 bp, Artificial sequence
  Synthetic oligonucleotide
cattgctgttgttgttc

SEQ ID NO: 1412 - DNA, 17 bp, Artificial sequence
  Synthetic oligonucleotide
taagttgtgaccatgca

SEQ ID NO: 1413 - DNA, 17 bp, Artificial sequence
  Synthetic oligonucleotide
agtaagttgtgaccatg

SEQ ID NO: 1414 - DNA, 17 bp, Artificial sequence
  Synthetic oligonucleotide
ttagtaagttgtgacca

SEQ ID NO: 1415 - DNA, 17 bp, Artificial sequence
  Synthetic oligonucleotide
aataaaaatgtgcatgc

SEQ ID NO: 1416 - DNA, 17 bp, Artificial sequence
  Synthetic oligonucleotide
aacaaaatacagtcaga

SEQ ID NO: 1417 - DNA, 17 bp, Artificial sequence
  Synthetic oligonucleotide
tttgtactgtgtgctgt

SEQ ID NO: 1418 - DNA, 17 bp, Artificial sequence
  Synthetic oligonucleotide
tgacatacaaacccaaa

SEQ ID NO: 1419 - DNA, 17 bp, Artificial sequence
  Synthetic oligonucleotide
cttgacatacaaaccca

SEQ ID NO: 1420 - DNA, 17 bp, Artificial sequence
  Synthetic oligonucleotide
gaagttaactccctaga

SEQ ID NO: 1421 - DNA, 17 bp, Artificial sequence
  Synthetic oligonucleotide
atgaagttaactcccta

SEQ ID NO: 1422 - DNA, 17 bp, Artificial sequence
  Synthetic oligonucleotide
agatgaagttaactccc

SEQ ID NO: 1423 - DNA, 17 bp, Artificial sequence
  Synthetic oligonucleotide
ttttcaagagcttttcg

SEQ ID NO: 1424 - DNA, 17 bp, Artificial sequence
  Synthetic oligonucleotide
ccttttcaagagctttt

SEQ ID NO: 1425 - DNA, 17 bp, Artificial sequence
  Synthetic oligonucleotide
tcccttttcaagagctt

SEQ ID NO: 1426 - DNA, 17 bp, Artificial sequence
  Synthetic oligonucleotide
tttcccttttcaagagc

SEQ ID NO: 1427 - DNA, 17 bp, Artificial sequence
  Synthetic oligonucleotide
tatttcccttttcaaga

SEQ ID NO: 1428 - DNA, 17 bp, Artificial sequence
  Synthetic oligonucleotide
acaagtaggtaggtcaa

SEQ ID NO: 1429 - DNA, 17 bp, Artificial sequence
  Synthetic oligonucleotide
tgagccatattcaatat

SEQ ID NO: 1430 - DNA, 17 bp, Artificial sequence
  Synthetic oligonucleotide
aaattgctaggttcaac

SEQ ID NO: 1431 - DNA, 17 bp, Artificial sequence
  Synthetic oligonucleotide
atcaaatatttactaga

SEQ ID NO: 1432 - DNA, 17 bp, Artificial sequence
  Synthetic oligonucleotide
acatacaaacccaaaga

SEQ ID NO: 1433 - DNA, 17 bp, Artificial sequence
  Synthetic oligonucleotide
cacttgacatacaaacc

SEQ ID NO: 1434 - DNA, 17 bp, Artificial sequence
  Synthetic oligonucleotide
gaagttaactcccttga

SEQ ID NO: 1435 - DNA, 17 bp, Artificial sequence
  Synthetic oligonucleotide
atgaagttaactccctt

SEQ ID NO: 1436 - DNA, 17 bp, Artificial sequence
  Synthetic oligonucleotide
ttttcaagagcttttct

SEQ ID NO: 1437 - DNA, 17 bp, Artificial sequence
  Synthetic oligonucleotide
tctacaggttatatgtg

SEQ ID NO: 1438 - DNA, 17 bp, Artificial sequence
  Synthetic oligonucleotide
tcccaaagtgcaagact

SEQ ID NO: 1439 - DNA, 17 bp, Artificial sequence
  Synthetic oligonucleotide
ctctattgttatatttt

SEQ ID NO: 1440 - DNA, 17 bp, Artificial sequence
  Synthetic oligonucleotide
atctaactcctagcaca

SEQ ID NO: 1441 - DNA, 17 bp, Artificial sequence
  Synthetic oligonucleotide
atactttctctgcataa

SEQ ID NO: 1442 - DNA, 17 bp, Artificial sequence
  Synthetic oligonucleotide
tagctatagtgcaatgg

SEQ ID NO: 1443 - DNA, 17 bp, Artificial sequence
  Synthetic oligonucleotide
ctggaattccagaaaaa

SEQ ID NO: 1444 - DNA, 17 bp, Artificial sequence
  Synthetic oligonucleotide
ctttcaaatctcattac

SEQ ID NO: 1445 - DNA, 17 bp, Artificial sequence
  Synthetic oligonucleotide
tcttcttttgcagagat

SEQ ID NO: 1446 - DNA, 17 bp, Artificial sequence
  Synthetic oligonucleotide
tagagcattaagaacat

SEQ ID NO: 1447 - DNA, 17 bp, Artificial sequence
  Synthetic oligonucleotide
gttactaaaaaaaacca

SEQ ID NO: 1448 - DNA, 17 bp, Artificial sequence
  Synthetic oligonucleotide
tcccattggactgagtt

SEQ ID NO: 1449 - DNA, 17 bp, Artificial sequence
  Synthetic oligonucleotide
tatccattttccagtta

SEQ ID NO: 1450 - DNA, 17 bp, Artificial sequence
  Synthetic oligonucleotide
ccagggtgctatacaaa

SEQ ID NO: 1451 - DNA, 17 bp, Artificial sequence
  Synthetic oligonucleotide
ccttaacaatcttattt

SEQ ID NO: 1452 - DNA, 17 bp, Artificial sequence
  Synthetic oligonucleotide
caccacattaattaaac

SEQ ID NO: 1453 - DNA, 17 bp, Artificial sequence
  Synthetic oligonucleotide
atgttttgagttccagg

SEQ ID NO: 1454 - DNA, 17 bp, Artificial sequence
  Synthetic oligonucleotide
taattaataatcatctt

SEQ ID NO: 1455 - DNA, 17 bp, Artificial sequence
  Synthetic oligonucleotide
ttctggctgactgaatt

SEQ ID NO: 1456 - DNA, 17 bp, Artificial sequence
  Synthetic oligonucleotide
tggcttctggctgactg

SEQ ID NO: 1457 - DNA, 17 bp, Artificial sequence
  Synthetic oligonucleotide
tgtggcttctggctgac

SEQ ID NO: 1458 - DNA, 17 bp, Artificial sequence
  Synthetic oligonucleotide
ggcttttaacaaaacaa

SEQ ID NO: 1459 - DNA, 17 bp, Artificial sequence
  Synthetic oligonucleotide
ataattcaagtcaggga

SEQ ID NO: 1460 - DNA, 17 bp, Artificial sequence
  Synthetic oligonucleotide
ccataattcaagtcagg

SEQ ID NO: 1461 - DNA, 17 bp, Artificial sequence
  Synthetic oligonucleotide
tgccataattcaagtca

SEQ ID NO: 1462 - DNA, 17 bp, Artificial sequence
  Synthetic oligonucleotide
actgccataattcaagt

SEQ ID NO: 1463 - DNA, 17 bp, Artificial sequence
  Synthetic oligonucleotide
taatattgtgaccactt

SEQ ID NO: 1464 - DNA, 17 bp, Artificial sequence
  Synthetic oligonucleotide
taagactattgctttgg

SEQ ID NO: 1465 - DNA, 17 bp, Artificial sequence
  Synthetic oligonucleotide
cataatagatgagttaa

SEQ ID NO: 1466 - DNA, 17 bp, Artificial sequence
  Synthetic oligonucleotide
ttcagttttgtggcggg

SEQ ID NO: 1467 - DNA, 17 bp, Artificial sequence
  Synthetic oligonucleotide
attacattaaaaggtgg

SEQ ID NO: 1468 - DNA, 17 bp, Artificial sequence
  Synthetic oligonucleotide
ccaccgtcactgcatac

SEQ ID NO: 1469 - DNA, 17 bp, Artificial sequence
  Synthetic oligonucleotide
actctgttgaattttct

SEQ ID NO: 1470 - DNA, 17 bp, Artificial sequence
  Synthetic oligonucleotide
tttccagtgctagtatt

SEQ ID NO: 1471 - DNA, 17 bp, Artificial sequence
  Synthetic oligonucleotide
aatgagatgaaaattga

SEQ ID NO: 1472 - DNA, 17 bp, Artificial sequence
  Synthetic oligonucleotide
agctagtttgtaaacaa

SEQ ID NO: 1473 - DNA, 17 bp, Artificial sequence
  Synthetic oligonucleotide
agaagcagtgaatccaa

SEQ ID NO: 1474 - DNA, 17 bp, Artificial sequence
  Synthetic oligonucleotide
ctgttaatcaccccttt

SEQ ID NO: 1475 - DNA, 17 bp, Artificial sequence
  Synthetic oligonucleotide
cacaatacagagcagag

SEQ ID NO: 1476 - DNA, 17 bp, Artificial sequence
  Synthetic oligonucleotide
agaagtcagacttcagg

SEQ ID NO: 1477 - DNA, 17 bp, Artificial sequence
  Synthetic oligonucleotide
atggaagatgaaaaagg

SEQ ID NO: 1478 - DNA, 17 bp, Artificial sequence
  Synthetic oligonucleotide
gttgagtctgagatgcc

SEQ ID NO: 1479 - DNA, 17 bp, Artificial sequence
  Synthetic oligonucleotide
aaggctgttcactatat

SEQ ID NO: 1480 - DNA, 17 bp, Artificial sequence
  Synthetic oligonucleotide
tcttgcactgattcctc

SEQ ID NO: 1481 - DNA, 17 bp, Artificial sequence
  Synthetic oligonucleotide
agataagaagcaaatgc

SEQ ID NO: 1482 - DNA, 17 bp, Artificial sequence
  Synthetic oligonucleotide
gaatgggcggatcacaa

SEQ ID NO: 1483 - DNA, 17 bp, Artificial sequence
  Synthetic oligonucleotide
gattattttaagcactt

SEQ ID NO: 1484 - DNA, 17 bp, Artificial sequence
  Synthetic oligonucleotide
agaaaaagggcatttaa

SEQ ID NO: 1485 - DNA, 17 bp, Artificial sequence
  Synthetic oligonucleotide
tgcaatgtgtaggtggg

SEQ ID NO: 1486 - DNA, 17 bp, Artificial sequence
  Synthetic oligonucleotide
acttttaaggcatccat

SEQ ID NO: 1487 - DNA, 17 bp, Artificial sequence
  Synthetic oligonucleotide
ccctcccaacaatttca

SEQ ID NO: 1488 - DNA, 17 bp, Artificial sequence
  Synthetic oligonucleotide
ctttccattattgttct

SEQ ID NO: 1489 - DNA, 17 bp, Artificial sequence
  Synthetic oligonucleotide
ggaaatgtttatatata

SEQ ID NO: 1490 - DNA, 17 bp, Artificial sequence
  Synthetic oligonucleotide
taggaagtctggctcca

SEQ ID NO: 1491 - DNA, 17 bp, Artificial sequence
  Synthetic oligonucleotide
gataatgggctaggtgt

SEQ ID NO: 1492 - DNA, 17 bp, Artificial sequence
  Synthetic oligonucleotide
tggaatatctttgctta

SEQ ID NO: 1493 - DNA, 17 bp, Artificial sequence
  Synthetic oligonucleotide
atagcttcaagatcggt

SEQ ID NO: 1494 - DNA, 17 bp, Artificial sequence
  Synthetic oligonucleotide
gagataaagagtctgct

SEQ ID NO: 1495 - DNA, 17 bp, Artificial sequence
  Synthetic oligonucleotide
tcacgggatcacgccat

SEQ ID NO: 1496 - DNA, 17 bp, Artificial sequence
  Synthetic oligonucleotide
tgactgaataagacatt

SEQ ID NO: 1497 - DNA, 17 bp, Artificial sequence
  Synthetic oligonucleotide
gcaacaactgccagctt

SEQ ID NO: 1498 - DNA, 17 bp, Artificial sequence
  Synthetic oligonucleotide
caggtttaaatacattc

SEQ ID NO: 1499 - DNA, 17 bp, Artificial sequence
  Synthetic oligonucleotide
ttggataatctgttact

SEQ ID NO: 1500 - DNA, 17 bp, Artificial sequence
  Synthetic oligonucleotide
taatgcagtgatacaat

SEQ ID NO: 1501 - DNA, 17 bp, Artificial sequence
  Synthetic oligonucleotide
ctggatcacttgggaat

SEQ ID NO: 1502 - DNA, 17 bp, Artificial sequence
  Synthetic oligonucleotide
tgttctaattaaaaagt

SEQ ID NO: 1503 - DNA, 17 bp, Artificial sequence
  Synthetic oligonucleotide
actttacaacaagataa

SEQ ID NO: 1504 - DNA, 17 bp, Artificial sequence
  Synthetic oligonucleotide
tgatacattataataca

SEQ ID NO: 1505 - DNA, 17 bp, Artificial sequence
  Synthetic oligonucleotide
gggaaagtatagttatg

SEQ ID NO: 1506 - DNA, 17 bp, Artificial sequence
  Synthetic oligonucleotide
gcataagaaagaacaat

SEQ ID NO: 1507 - DNA, 17 bp, Artificial sequence
  Synthetic oligonucleotide
tcttgaggtcataaatc

SEQ ID NO: 1508 - DNA, 17 bp, Artificial sequence
  Synthetic oligonucleotide
aaatgaaggcgatagac

SEQ ID NO: 1509 - DNA, 17 bp, Artificial sequence
  Synthetic oligonucleotide
ctaaaaaagaactttga

SEQ ID NO: 1510 - DNA, 17 bp, Artificial sequence
  Synthetic oligonucleotide
tgtgtgatcaactttca

SEQ ID NO: 1511 - DNA, 17 bp, Artificial sequence
  Synthetic oligonucleotide
agtaagcttcaattggt

SEQ ID NO: 1512 - DNA, 17 bp, Artificial sequence
  Synthetic oligonucleotide
aggtttcatcaattatc

SEQ ID NO: 1513 - DNA, 17 bp, Artificial sequence
  Synthetic oligonucleotide
agtgtcttgttaagtat

SEQ ID NO: 1514 - DNA, 17 bp, Artificial sequence
  Synthetic oligonucleotide
gaatttacataatcttt

SEQ ID NO: 1515 - DNA, 17 bp, Artificial sequence
  Synthetic oligonucleotide
ctttttaaataaacctg

SEQ ID NO: 1516 - DNA, 17 bp, Artificial sequence
  Synthetic oligonucleotide
gaatagctgtagacttt

SEQ ID NO: 1517 - DNA, 17 bp, Artificial sequence
  Synthetic oligonucleotide
taccaatataacaaatg

SEQ ID NO: 1518 - DNA, 17 bp, Artificial sequence
  Synthetic oligonucleotide
tatttactgtttcataa

SEQ ID NO: 1519 - DNA, 17 bp, Artificial sequence
  Synthetic oligonucleotide
tcaggtgtcctagtggg

SEQ ID NO: 1520 - DNA, 17 bp, Artificial sequence
  Synthetic oligonucleotide
gcaaccccaaaatacta

SEQ ID NO: 1521 - DNA, 17 bp, Artificial sequence
  Synthetic oligonucleotide
gtgtgatgatatattgc

SEQ ID NO: 1522 - DNA, 17 bp, Artificial sequence
  Synthetic oligonucleotide
acaagacaaagaatacg

SEQ ID NO: 1523 - DNA, 17 bp, Artificial sequence
  Synthetic oligonucleotide
gttctcctatagtccca

SEQ ID NO: 1524 - DNA, 17 bp, Artificial sequence
  Synthetic oligonucleotide
actagggatgacagcac

SEQ ID NO: 1525 - DNA, 17 bp, Artificial sequence
  Synthetic oligonucleotide
ttcttgcttatatcaat

SEQ ID NO: 1526 - DNA, 17 bp, Artificial sequence
  Synthetic oligonucleotide
gcagtaatggaacagcg

SEQ ID NO: 1527 - DNA, 17 bp, Artificial sequence
  Synthetic oligonucleotide
attttgatatggaccag

SEQ ID NO: 1528 - DNA, 17 bp, Artificial sequence
  Synthetic oligonucleotide
tgctgagaagtttccta

SEQ ID NO: 1529 - DNA, 17 bp, Artificial sequence
  Synthetic oligonucleotide
tgccctttttataaact

SEQ ID NO: 1530 - DNA, 17 bp, Artificial sequence
  Synthetic oligonucleotide
agcctaaagggacttgg

SEQ ID NO: 1531 - DNA, 17 bp, Artificial sequence
  Synthetic oligonucleotide
agactgagactatacat

SEQ ID NO: 1532 - DNA, 17 bp, Artificial sequence
  Synthetic oligonucleotide
gtctatattatagatac

SEQ ID NO: 1533 - DNA, 17 bp, Artificial sequence
  Synthetic oligonucleotide
ttacaatgaaaccccat

SEQ ID NO: 1534 - DNA, 17 bp, Artificial sequence
  Synthetic oligonucleotide
tttactatttaggaaat

SEQ ID NO: 1535 - DNA, 17 bp, Artificial sequence
  Synthetic oligonucleotide
aagtaagaagcacaaaa

SEQ ID NO: 1536 - DNA, 17 bp, Artificial sequence
  Synthetic oligonucleotide
aacttgcaagttgtcca

SEQ ID NO: 1537 - DNA, 17 bp, Artificial sequence
  Synthetic oligonucleotide
gatttccctaactttcc

SEQ ID NO: 1538 - DNA, 17 bp, Artificial sequence
  Synthetic oligonucleotide
atgtctcctcttctgtt

SEQ ID NO: 1539 - DNA, 17 bp, Artificial sequence
  Synthetic oligonucleotide
gtaacctggccactttg

SEQ ID NO: 1540 - DNA, 17 bp, Artificial sequence
  Synthetic oligonucleotide
tgtctgtgtgagacagt

SEQ ID NO: 1541 - DNA, 17 bp, Artificial sequence
  Synthetic oligonucleotide
atcataatgaagaaatg

SEQ ID NO: 1542 - DNA, 17 bp, Artificial sequence
  Synthetic oligonucleotide
tgcctttgcttctgata

SEQ ID NO: 1543 - DNA, 17 bp, Artificial sequence
  Synthetic oligonucleotide
atatcaggattctgctt

SEQ ID NO: 1544 - DNA, 17 bp, Artificial sequence
  Synthetic oligonucleotide
gatgctctaattctcag

SEQ ID NO: 1545 - DNA, 17 bp, Artificial sequence
  Synthetic oligonucleotide
cactctttcagagctgg

SEQ ID NO: 1546 - DNA, 17 bp, Artificial sequence
  Synthetic oligonucleotide
ccacactctttcagagc

SEQ ID NO: 1547 - DNA, 17 bp, Artificial sequence
  Synthetic oligonucleotide
acaccacactctttcag

SEQ ID NO: 1548 - DNA, 17 bp, Artificial sequence
  Synthetic oligonucleotide
tttacaccacactcttt

SEQ ID NO: 1549 - DNA, 17 bp, Artificial sequence
  Synthetic oligonucleotide
ctttacaccacactctt

SEQ ID NO: 1550 - DNA, 17 bp, Artificial sequence
  Synthetic oligonucleotide
tcctttacaccacactc

SEQ ID NO: 1551 - DNA, 17 bp, Artificial sequence
  Synthetic oligonucleotide
accacactcacttccgc

SEQ ID NO: 1552 - DNA, 17 bp, Artificial sequence
  Synthetic oligonucleotide
tacaccacactcacttc

SEQ ID NO: 1553 - DNA, 17 bp, Artificial sequence
  Synthetic oligonucleotide
ctttacaccacactcac

SEQ ID NO: 1554 - DNA, 17 bp, Artificial sequence
  Synthetic oligonucleotide
cactacatagagaacac

SEQ ID NO: 1555 - DNA, 17 bp, Artificial sequence
  Synthetic oligonucleotide
agccactacatagagaa

SEQ ID NO: 1556 - DNA, 17 bp, Artificial sequence
  Synthetic oligonucleotide
ctcagccactacataga

SEQ ID NO: 1557 - DNA, 17 bp, Artificial sequence
  Synthetic oligonucleotide
cttctcagccactacat

SEQ ID NO: 1558 - DNA, 17 bp, Artificial sequence
  Synthetic oligonucleotide
ggtcttctcagccacta

SEQ ID NO: 1559 - DNA, 17 bp, Artificial sequence
  Synthetic oligonucleotide
tccttgcccaactggtc

SEQ ID NO: 1560 - DNA, 17 bp, Artificial sequence
  Synthetic oligonucleotide
ccttccttgcccaactg

SEQ ID NO: 1561 - DNA, 17 bp, Artificial sequence
  Synthetic oligonucleotide
tacccttccttgcccaa

SEQ ID NO: 1562 - DNA, 17 bp, Artificial sequence
  Synthetic oligonucleotide
tgatacccttccttgcc

SEQ ID NO: 1563 - DNA, 17 bp, Artificial sequence
  Synthetic oligonucleotide
tcttgatacccttcctt

SEQ ID NO: 1564 - DNA, 17 bp, Artificial sequence
  Synthetic oligonucleotide
gtcaaaatattcttact

SEQ ID NO: 1565 - DNA, 17 bp, Artificial sequence
  Synthetic oligonucleotide
cacataaaattaaagct

SEQ ID NO: 1566 - DNA, 17 bp, Artificial sequence
  Synthetic oligonucleotide
tccatgaagccaagtaa

SEQ ID NO: 1567 - DNA, 17 bp, Artificial sequence
  Synthetic oligonucleotide
tttccatgaagccaagt

SEQ ID NO: 1568 - DNA, 17 bp, Artificial sequence
  Synthetic oligonucleotide
gatttccatgaagccaa

SEQ ID NO: 1569 - DNA, 17 bp, Artificial sequence
  Synthetic oligonucleotide
gagatttccatgaagcc

SEQ ID NO: 1570 - DNA, 17 bp, Artificial sequence
  Synthetic oligonucleotide
ggaattggagtgagaga

SEQ ID NO: 1571 - DNA, 17 bp, Artificial sequence
  Synthetic oligonucleotide
atccctacatactcaca

SEQ ID NO: 1572 - DNA, 17 bp, Artificial sequence
  Synthetic oligonucleotide
ttctaccacccacagct

SEQ ID NO: 1573 - DNA, 17 bp, Artificial sequence
  Synthetic oligonucleotide
gaaaacattgtattatt

SEQ ID NO: 1574 - DNA, 17 bp, Artificial sequence
  Synthetic oligonucleotide
ccttaaaatgatgcctg

SEQ ID NO: 1575 - DNA, 17 bp, Artificial sequence
  Synthetic oligonucleotide
ctaaagttaaggtgtcg

SEQ ID NO: 1576 - DNA, 17 bp, Artificial sequence
  Synthetic oligonucleotide
gcatgaattactttacg

SEQ ID NO: 1577 - DNA, 17 bp, Artificial sequence
  Synthetic oligonucleotide
ggttgttcaagtgattc

SEQ ID NO: 1578 - DNA, 17 bp, Artificial sequence
  Synthetic oligonucleotide
gatcttttcatcatgcc

SEQ ID NO: 1579 - DNA, 17 bp, Artificial sequence
  Synthetic oligonucleotide
ggtcatgactctgacac

SEQ ID NO: 1580 - DNA, 17 bp, Artificial sequence
  Synthetic oligonucleotide
ctggtcatgactctgac

SEQ ID NO: 1581 - DNA, 17 bp, Artificial sequence
  Synthetic oligonucleotide
ccctggtcatgactctg

SEQ ID NO: 1582 - DNA, 17 bp, Artificial sequence
  Synthetic oligonucleotide
tcccctggtcatgactc

SEQ ID NO: 1583 - DNA, 17 bp, Artificial sequence
  Synthetic oligonucleotide
agggccatcctgttcaa

SEQ ID NO: 1584 - DNA, 17 bp, Artificial sequence
  Synthetic oligonucleotide
agaatacttattttttg

SEQ ID NO: 1585 - DNA, 17 bp, Artificial sequence
  Synthetic oligonucleotide
attttggatgcttctga

SEQ ID NO: 1586 - DNA, 17 bp, Artificial sequence
  Synthetic oligonucleotide
gtattttggatgcttct

SEQ ID NO: 1587 - DNA, 17 bp, Artificial sequence
  Synthetic oligonucleotide
ttgtattttggatgctt

SEQ ID NO: 1588 - DNA, 17 bp, Artificial sequence
  Synthetic oligonucleotide
gtttgtattttggatgc

SEQ ID NO: 1589 - DNA, 17 bp, Artificial sequence
  Synthetic oligonucleotide
tttaaagatggatattg

SEQ ID NO: 1590 - DNA, 17 bp, Artificial sequence
  Synthetic oligonucleotide
taaggtccctccctcaa

SEQ ID NO: 1591 - DNA, 17 bp, Artificial sequence
  Synthetic oligonucleotide
ttacctggctacctttt

SEQ ID NO: 1592 - DNA, 17 bp, Artificial sequence
  Synthetic oligonucleotide
tgaaattttccagctat

SEQ ID NO: 1593 - DNA, 17 bp, Artificial sequence
  Synthetic oligonucleotide
attgaaattttccagct

SEQ ID NO: 1594 - DNA, 17 bp, Artificial sequence
  Synthetic oligonucleotide
tgattgaaattttccag

SEQ ID NO: 1595 - DNA, 17 bp, Artificial sequence
  Synthetic oligonucleotide
tgggaatcacctcccct

SEQ ID NO: 1596 - DNA, 17 bp, Artificial sequence
  Synthetic oligonucleotide
cattgaattaatttgtt

SEQ ID NO: 1597 - DNA, 17 bp, Artificial sequence
  Synthetic oligonucleotide
caccattttatagcatg

SEQ ID NO: 1598 - DNA, 17 bp, Artificial sequence
  Synthetic oligonucleotide
tggaaagaggtatgagt

SEQ ID NO: 1599 - DNA, 17 bp, Artificial sequence
  Synthetic oligonucleotide
attaaaatgagaggtcc

SEQ ID NO: 1600 - DNA, 17 bp, Artificial sequence
  Synthetic oligonucleotide
ttccaccacacaagtta

SEQ ID NO: 1601 - DNA, 17 bp, Artificial sequence
  Synthetic oligonucleotide
ttcatcaatatctgcaa

SEQ ID NO: 1602 - DNA, 17 bp, Artificial sequence
  Synthetic oligonucleotide
ttttcatcaatatctgc

SEQ ID NO: 1603 - DNA, 17 bp, Artificial sequence
  Synthetic oligonucleotide
ggttttcatcaatatct

SEQ ID NO: 1604 - DNA, 17 bp, Artificial sequence
  Synthetic oligonucleotide
ctttgatgaattaagag

SEQ ID NO: 1605 - DNA, 17 bp, Artificial sequence
  Synthetic oligonucleotide
aggtataagattcctgc

SEQ ID NO: 1606 - DNA, 17 bp, Artificial sequence
  Synthetic oligonucleotide
acaaggccttacttacg

SEQ ID NO: 1607 - DNA, 17 bp, Artificial sequence
  Synthetic oligonucleotide
ctgcccaacttacaatt

SEQ ID NO: 1608 - DNA, 17 bp, Artificial sequence
  Synthetic oligonucleotide
catggcaagaacaaggg

SEQ ID NO: 1609 - DNA, 17 bp, Artificial sequence
  Synthetic oligonucleotide
tattatgtgcttattgg

SEQ ID NO: 1610 - DNA, 17 bp, Artificial sequence
  Synthetic oligonucleotide
cctaacacatggatgta

SEQ ID NO: 1611 - DNA, 17 bp, Artificial sequence
  Synthetic oligonucleotide
caaatgtatagagaagt

SEQ ID NO: 1612 - DNA, 17 bp, Artificial sequence
  Synthetic oligonucleotide
atcaaatgtatagagaa

SEQ ID NO: 1613 - DNA, 17 bp, Artificial sequence
  Synthetic oligonucleotide
agatcaaatgtatagag

SEQ ID NO: 1614 - DNA, 17 bp, Artificial sequence
  Synthetic oligonucleotide
acagatcaaatgtatag

SEQ ID NO: 1615 - DNA, 17 bp, Artificial sequence
  Synthetic oligonucleotide
ctctactgtgtttgagc

SEQ ID NO: 1616 - DNA, 17 bp, Artificial sequence
  Synthetic oligonucleotide
ctatatactacaatttt

SEQ ID NO: 1617 - DNA, 17 bp, Artificial sequence
  Synthetic oligonucleotide
tgagctcactgacagaa

SEQ ID NO: 1618 - DNA, 17 bp, Artificial sequence
  Synthetic oligonucleotide
caagtataaatatgttt

SEQ ID NO: 1619 - DNA, 17 bp, Artificial sequence
  Synthetic oligonucleotide
ccaaggagcatttggat

SEQ ID NO: 1620 - DNA, 17 bp, Artificial sequence
  Synthetic oligonucleotide
tccatgaagccaagatc

SEQ ID NO: 1621 - DNA, 17 bp, Artificial sequence
  Synthetic oligonucleotide
tttccatgaagccaaga

SEQ ID NO: 1622 - DNA, 17 bp, Artificial sequence
  Synthetic oligonucleotide
tatttccatgaagccaa

SEQ ID NO: 1623 - DNA, 17 bp, Artificial sequence
  Synthetic oligonucleotide
attatttccatgaagcc

SEQ ID NO: 1624 - DNA, 17 bp, Artificial sequence
  Synthetic oligonucleotide
atccataaatgctttgt

SEQ ID NO: 1625 - DNA, 17 bp, Artificial sequence
  Synthetic oligonucleotide
tatcttcatcatagctc

SEQ ID NO: 1626 - DNA, 17 bp, Artificial sequence
  Synthetic oligonucleotide
agaccacactccaacta

SEQ ID NO: 1627 - DNA, 17 bp, Artificial sequence
  Synthetic oligonucleotide
atgtaaggatgatcatt

SEQ ID NO: 1628 - DNA, 17 bp, Artificial sequence
  Synthetic oligonucleotide
tgactttatatgcattt

SEQ ID NO: 1629 - DNA, 17 bp, Artificial sequence
  Synthetic oligonucleotide
catatatacttacttac

SEQ ID NO: 1630 - DNA, 17 bp, Artificial sequence
  Synthetic oligonucleotide
atatgtttgatcgaaag

SEQ ID NO: 1631 - DNA, 17 bp, Artificial sequence
  Synthetic oligonucleotide
cagatggttttttcttt

SEQ ID NO: 1632 - DNA, 17 bp, Artificial sequence
  Synthetic oligonucleotide
acaaaagggattgttct

SEQ ID NO: 1633 - DNA, 17 bp, Artificial sequence
  Synthetic oligonucleotide
acttgactataacactt

SEQ ID NO: 1634 - DNA, 17 bp, Artificial sequence
  Synthetic oligonucleotide
atagaaaacagatgaag

SEQ ID NO: 1635 - DNA, 20 bp, Artificial sequence
  Synthetic oligonucleotide
tcctttacaccacactgtcg

SEQ ID NO: 1636 - DNA, 20 bp, Artificial sequence
  Synthetic oligonucleotide
ttcctttacaccacactgtc

SEQ ID NO: 1637 - DNA, 20 bp, Artificial sequence
  Synthetic oligonucleotide
attcctttacaccacactgt

SEQ ID NO: 1638 - DNA, 20 bp, Artificial sequence
  Synthetic oligonucleotide
gaattcctttacaccacact

SEQ ID NO: 1639 - DNA, 20 bp, Artificial sequence
  Synthetic oligonucleotide
tgaattcctttacaccacac

SEQ ID NO: 1640 - DNA, 20 bp, Artificial sequence
  Synthetic oligonucleotide
atgaattcctttacaccaca

SEQ ID NO: 1641 - DNA, 20 bp, Artificial sequence
  Synthetic oligonucleotide
aatgaattcctttacaccac

SEQ ID NO: 1642 - DNA, 20 bp, Artificial sequence
  Synthetic oligonucleotide
taatgaattcctttacacca

SEQ ID NO: 1643 - DNA, 20 bp, Artificial sequence
  Synthetic oligonucleotide
ctaatgaattcctttacacc

SEQ ID NO: 1644 - DNA, 20 bp, Artificial sequence
  Synthetic oligonucleotide
gctaatgaattcctttacac

SEQ ID NO: 1645 - DNA, 20 bp, Artificial sequence
  Synthetic oligonucleotide
ggctaatgaattcctttaca

SEQ ID NO: 1646 - DNA, 20 bp, Artificial sequence
  Synthetic oligonucleotide
acatccatggctaatgaatt

SEQ ID NO: 1647 - DNA, 20 bp, Artificial sequence
  Synthetic oligonucleotide
tacatccatggctaatgaat

SEQ ID NO: 1648 - DNA, 20 bp, Artificial sequence
  Synthetic oligonucleotide
atacatccatggctaatgaa

SEQ ID NO: 1649 - DNA, 20 bp, Artificial sequence
  Synthetic oligonucleotide
aatacatccatggctaatga

SEQ ID NO: 1650 - DNA, 20 bp, Artificial sequence
  Synthetic oligonucleotide
tgaatacatccatggctaat

SEQ ID NO: 1651 - DNA, 20 bp, Artificial sequence
  Synthetic oligonucleotide
atgaatacatccatggctaa

SEQ ID NO: 1652 - DNA, 20 bp, Artificial sequence
  Synthetic oligonucleotide
catgaatacatccatggcta

SEQ ID NO: 1653 - DNA, 20 bp, Artificial sequence
  Synthetic oligonucleotide
tcatgaatacatccatggct

SEQ ID NO: 1654 - DNA, 20 bp, Artificial sequence
  Synthetic oligonucleotide
ttcatgaatacatccatggc

SEQ ID NO: 1655 - DNA, 20 bp, Artificial sequence
  Synthetic oligonucleotide
tttcatgaatacatccatgg

SEQ ID NO: 1656 - DNA, 20 bp, Artificial sequence
  Synthetic oligonucleotide
ctttcatgaatacatccatg

SEQ ID NO: 1657 - DNA, 20 bp, Artificial sequence
  Synthetic oligonucleotide
tcctttcatgaatacatcca

SEQ ID NO: 1658 - DNA, 20 bp, Artificial sequence
  Synthetic oligonucleotide
gtcctttcatgaatacatcc

SEQ ID NO: 1659 - DNA, 20 bp, Artificial sequence
  Synthetic oligonucleotide
agtcctttcatgaatacatc

SEQ ID NO: 1660 - DNA, 20 bp, Artificial sequence
  Synthetic oligonucleotide
aagtcctttcatgaatacat

SEQ ID NO: 1661 - DNA, 20 bp, Artificial sequence
  Synthetic oligonucleotide
aaagtcctttcatgaataca

SEQ ID NO: 1662 - DNA, 20 bp, Artificial sequence
  Synthetic oligonucleotide
gaaagtcctttcatgaatac

SEQ ID NO: 1663 - DNA, 20 bp, Artificial sequence
  Synthetic oligonucleotide
tgaaagtcctttcatgaata

SEQ ID NO: 1664 - DNA, 20 bp, Artificial sequence
  Synthetic oligonucleotide
ttgaaagtcctttcatgaat

SEQ ID NO: 1665 - DNA, 20 bp, Artificial sequence
  Synthetic oligonucleotide
tttgaaagtcctttcatgaa

SEQ ID NO: 1666 - DNA, 20 bp, Artificial sequence
  Synthetic oligonucleotide
acttgctctttggtcttctc

SEQ ID NO: 1667 - DNA, 20 bp, Artificial sequence
  Synthetic oligonucleotide
cacttgctctttggtcttct

SEQ ID NO: 1668 - DNA, 20 bp, Artificial sequence
  Synthetic oligonucleotide
tcacttgctctttggtcttc

SEQ ID NO: 1669 - DNA, 20 bp, Artificial sequence
  Synthetic oligonucleotide
gtcacttgctctttggtctt

SEQ ID NO: 1670 - DNA, 20 bp, Artificial sequence
  Synthetic oligonucleotide
tgtcacttgctctttggtct

SEQ ID NO: 1671 - DNA, 20 bp, Artificial sequence
  Synthetic oligonucleotide
ttgtcacttgctctttggtc

SEQ ID NO: 1672 - DNA, 20 bp, Artificial sequence
  Synthetic oligonucleotide
tttgtcacttgctctttggt

SEQ ID NO: 1673 - DNA, 20 bp, Artificial sequence
  Synthetic oligonucleotide
atttgtcacttgctctttgg

SEQ ID NO: 1674 - DNA, 20 bp, Artificial sequence
  Synthetic oligonucleotide
catttgtcacttgctctttg

SEQ ID NO: 1675 - DNA, 20 bp, Artificial sequence
  Synthetic oligonucleotide
acatttgtcacttgctcttt

SEQ ID NO: 1676 - DNA, 20 bp, Artificial sequence
  Synthetic oligonucleotide
aacatttgtcacttgctctt

SEQ ID NO: 1677 - DNA, 20 bp, Artificial sequence
  Synthetic oligonucleotide
tttacaccacactggaaaac

SEQ ID NO: 1678 - DNA, 20 bp, Artificial sequence
  Synthetic oligonucleotide
ctttacaccacactggaaaa

SEQ ID NO: 1679 - DNA, 20 bp, Artificial sequence
  Synthetic oligonucleotide
cctttacaccacactggaaa

SEQ ID NO: 1680 - DNA, 20 bp, Artificial sequence
  Synthetic oligonucleotide
tcctttacaccacactggaa

SEQ ID NO: 1681 - DNA, 20 bp, Artificial sequence
  Synthetic oligonucleotide
ttcctttacaccacactgga

SEQ ID NO: 1682 - DNA, 20 bp, Artificial sequence
  Synthetic oligonucleotide
attcctttacaccacactgg

SEQ ID NO: 1683 - DNA, 20 bp, Artificial sequence
  Synthetic oligonucleotide
tataaatgtaacacaaaacg

SEQ ID NO: 1684 - DNA, 20 bp, Artificial sequence
  Synthetic oligonucleotide
gtagcactttttcacaaggg

SEQ ID NO: 1685 - DNA, 20 bp, Artificial sequence
  Synthetic oligonucleotide
ctttcttccagaaattgaaa

SEQ ID NO: 1686 - DNA, 20 bp, Artificial sequence
  Synthetic oligonucleotide
aaattccaagacttacaatt

SEQ ID NO: 1687 - DNA, 20 bp, Artificial sequence
  Synthetic oligonucleotide
agagatgatgtcactataaa

SEQ ID NO: 1688 - DNA, 20 bp, Artificial sequence
  Synthetic oligonucleotide
tctctggttggtatgtattt

SEQ ID NO: 1689 - DNA, 20 bp, Artificial sequence
  Synthetic oligonucleotide
tatctttggtataatcttat

SEQ ID NO: 1690 - DNA, 20 bp, Artificial sequence
  Synthetic oligonucleotide
ttattttgctgttgtagtgg

SEQ ID NO: 1691 - DNA, 20 bp, Artificial sequence
  Synthetic oligonucleotide
ggcaggcctccccaagaacg

SEQ ID NO: 1692 - DNA, 20 bp, Artificial sequence
  Synthetic oligonucleotide
ggcaaagaaaggaaaaagaa

SEQ ID NO: 1693 - DNA, 20 bp, Artificial sequence
  Synthetic oligonucleotide
atggtgcctacattctagaa

SEQ ID NO: 1694 - DNA, 20 bp, Artificial sequence
  Synthetic oligonucleotide
cttaatttaataaatgtttg

SEQ ID NO: 1695 - DNA, 20 bp, Artificial sequence
  Synthetic oligonucleotide
ttggatagctgaatagcact

SEQ ID NO: 1696 - DNA, 20 bp, Artificial sequence
  Synthetic oligonucleotide
tgaagtggaaacaacccaga

SEQ ID NO: 1697 - DNA, 20 bp, Artificial sequence
  Synthetic oligonucleotide
atttttgttctgccttttta

SEQ ID NO: 1698 - DNA, 20 bp, Artificial sequence
  Synthetic oligonucleotide
tatttttgttctgccttttt

SEQ ID NO: 1699 - DNA, 20 bp, Artificial sequence
  Synthetic oligonucleotide
atatttttgttctgcctttt

SEQ ID NO: 1700 - DNA, 20 bp, Artificial sequence
  Synthetic oligonucleotide
gatatttttgttctgccttt

SEQ ID NO: 1701 - DNA, 20 bp, Artificial sequence
  Synthetic oligonucleotide
agatatttttgttctgcctt

SEQ ID NO: 1702 - DNA, 20 bp, Artificial sequence
  Synthetic oligonucleotide
cagatatttttgttctgcct

SEQ ID NO: 1703 - DNA, 20 bp, Artificial sequence
  Synthetic oligonucleotide
acagatatttttgttctgcc

SEQ ID NO: 1704 - DNA, 20 bp, Artificial sequence
  Synthetic oligonucleotide
cacagatatttttgttctgc

SEQ ID NO: 1705 - DNA, 20 bp, Artificial sequence
  Synthetic oligonucleotide
tcacagatatttttgttctg

SEQ ID NO: 1706 - DNA, 20 bp, Artificial sequence
  Synthetic oligonucleotide
atcacagatatttttgttct

SEQ ID NO: 1707 - DNA, 20 bp, Artificial sequence
  Synthetic oligonucleotide
tatcacagatatttttgttc

SEQ ID NO: 1708 - DNA, 20 bp, Artificial sequence
  Synthetic oligonucleotide
taaatctaaatatatcacag

SEQ ID NO: 1709 - DNA, 20 bp, Artificial sequence
  Synthetic oligonucleotide
aacattagctgaagaacttc

SEQ ID NO: 1710 - DNA, 20 bp, Artificial sequence
  Synthetic oligonucleotide
aaccaggaattaatataatt

SEQ ID NO: 1711 - DNA, 20 bp, Artificial sequence
  Synthetic oligonucleotide
ctgattaattgcctgtgtac

SEQ ID NO: 1712 - DNA, 20 bp, Artificial sequence
  Synthetic oligonucleotide
attaagctctttgatgtgcg

SEQ ID NO: 1713 - DNA, 20 bp, Artificial sequence
  Synthetic oligonucleotide
tcttggactacccacttcct

SEQ ID NO: 1714 - DNA, 20 bp, Artificial sequence
  Synthetic oligonucleotide
aaggaaggtaagttttgagg

SEQ ID NO: 1715 - DNA, 20 bp, Artificial sequence
  Synthetic oligonucleotide
agacggtacatgtttccctg

SEQ ID NO: 1716 - DNA, 20 bp, Artificial sequence
  Synthetic oligonucleotide
tgtatgccttaaatgcaggt

SEQ ID NO: 1717 - DNA, 20 bp, Artificial sequence
  Synthetic oligonucleotide
tgggtggaaagcaaacccag

SEQ ID NO: 1718 - DNA, 20 bp, Artificial sequence
  Synthetic oligonucleotide
ctacctataagggaaatatc

SEQ ID NO: 1719 - DNA, 20 bp, Artificial sequence
  Synthetic oligonucleotide
tcactctcagtccaatgttt

SEQ ID NO: 1720 - DNA, 20 bp, Artificial sequence
  Synthetic oligonucleotide
gagcttcctcattttatgag

SEQ ID NO: 1721 - DNA, 20 bp, Artificial sequence
  Synthetic oligonucleotide
accacaattgcagacattta

SEQ ID NO: 1722 - DNA, 20 bp, Artificial sequence
  Synthetic oligonucleotide
tcaaagtttaaaaaatgaaa

SEQ ID NO: 1723 - DNA, 20 bp, Artificial sequence
  Synthetic oligonucleotide
tcttgaatgatgaatgagtg

SEQ ID NO: 1724 - DNA, 20 bp, Artificial sequence
  Synthetic oligonucleotide
tgagcaaacattctttcttg

SEQ ID NO: 1725 - DNA, 20 bp, Artificial sequence
  Synthetic oligonucleotide
gtgagcaaacattctttctt

SEQ ID NO: 1726 - DNA, 20 bp, Artificial sequence
  Synthetic oligonucleotide
tgtgagcaaacattctttct

SEQ ID NO: 1727 - DNA, 20 bp, Artificial sequence
  Synthetic oligonucleotide
gtgtgagcaaacattctttc

SEQ ID NO: 1728 - DNA, 20 bp, Artificial sequence
  Synthetic oligonucleotide
agtgtgagcaaacattcttt

SEQ ID NO: 1729 - DNA, 20 bp, Artificial sequence
  Synthetic oligonucleotide
cagtgtgagcaaacattctt

SEQ ID NO: 1730 - DNA, 20 bp, Artificial sequence
  Synthetic oligonucleotide
acagtgtgagcaaacattct

SEQ ID NO: 1731 - DNA, 20 bp, Artificial sequence
  Synthetic oligonucleotide
cacagtgtgagcaaacattc

SEQ ID NO: 1732 - DNA, 20 bp, Artificial sequence
  Synthetic oligonucleotide
gcacagtgtgagcaaacatt

SEQ ID NO: 1733 - DNA, 20 bp, Artificial sequence
  Synthetic oligonucleotide
ggcacagtgtgagcaaacat

SEQ ID NO: 1734 - DNA, 20 bp, Artificial sequence
  Synthetic oligonucleotide
tggcacagtgtgagcaaaca

SEQ ID NO: 1735 - DNA, 20 bp, Artificial sequence
  Synthetic oligonucleotide
tttctggcacagtgtgagca

SEQ ID NO: 1736 - DNA, 20 bp, Artificial sequence
  Synthetic oligonucleotide
gtttctggcacagtgtgagc

SEQ ID NO: 1737 - DNA, 20 bp, Artificial sequence
  Synthetic oligonucleotide
agtttctggcacagtgtgag

SEQ ID NO: 1738 - DNA, 20 bp, Artificial sequence
  Synthetic oligonucleotide
aagtttctggcacagtgtga

SEQ ID NO: 1739 - DNA, 20 bp, Artificial sequence
  Synthetic oligonucleotide
caagtttctggcacagtgtg

SEQ ID NO: 1740 - DNA, 20 bp, Artificial sequence
  Synthetic oligonucleotide
ccaagtttctggcacagtgt

SEQ ID NO: 1741 - DNA, 20 bp, Artificial sequence
  Synthetic oligonucleotide
tccaagtttctggcacagtg

SEQ ID NO: 1742 - DNA, 20 bp, Artificial sequence
  Synthetic oligonucleotide
ctccaagtttctggcacagt

SEQ ID NO: 1743 - DNA, 20 bp, Artificial sequence
  Synthetic oligonucleotide
cctccaagtttctggcacag

SEQ ID NO: 1744 - DNA, 20 bp, Artificial sequence
  Synthetic oligonucleotide
tcctccaagtttctggcaca

SEQ ID NO: 1745 - DNA, 20 bp, Artificial sequence
  Synthetic oligonucleotide
ttcctccaagtttctggcac

SEQ ID NO: 1746 - DNA, 20 bp, Artificial sequence
  Synthetic oligonucleotide
attaatccacttctacaagc

SEQ ID NO: 1747 - DNA, 20 bp, Artificial sequence
  Synthetic oligonucleotide
gagggtgatggaccagatac

SEQ ID NO: 1748 - DNA, 20 bp, Artificial sequence
  Synthetic oligonucleotide
cagaattatgtcatttaatt

SEQ ID NO: 1749 - DNA, 20 bp, Artificial sequence
  Synthetic oligonucleotide
tcagaattatgtcatttaat

SEQ ID NO: 1750 - DNA, 20 bp, Artificial sequence
  Synthetic oligonucleotide
ttcagaattatgtcatttaa

SEQ ID NO: 1751 - DNA, 20 bp, Artificial sequence
  Synthetic oligonucleotide
gttcagaattatgtcattta

SEQ ID NO: 1752 - DNA, 20 bp, Artificial sequence
  Synthetic oligonucleotide
tgttcagaattatgtcattt

SEQ ID NO: 1753 - DNA, 20 bp, Artificial sequence
  Synthetic oligonucleotide
ttgttcagaattatgtcatt

SEQ ID NO: 1754 - DNA, 20 bp, Artificial sequence
  Synthetic oligonucleotide
gttgttcagaattatgtcat

SEQ ID NO: 1755 - DNA, 20 bp, Artificial sequence
  Synthetic oligonucleotide
ggttgttcagaattatgtca

SEQ ID NO: 1756 - DNA, 20 bp, Artificial sequence
  Synthetic oligonucleotide
tggttgttcagaattatgtc

SEQ ID NO: 1757 - DNA, 20 bp, Artificial sequence
  Synthetic oligonucleotide
ttggttgttcagaattatgt

SEQ ID NO: 1758 - DNA, 20 bp, Artificial sequence
  Synthetic oligonucleotide
attggttgttcagaattatg

SEQ ID NO: 1759 - DNA, 20 bp, Artificial sequence
  Synthetic oligonucleotide
atttactctcgatttattgg

SEQ ID NO: 1760 - DNA, 20 bp, Artificial sequence
  Synthetic oligonucleotide
tcatttgtcctttaactagt

SEQ ID NO: 1761 - DNA, 20 bp, Artificial sequence
  Synthetic oligonucleotide
taaaaatatggatcaaaaga

SEQ ID NO: 1762 - DNA, 20 bp, Artificial sequence
  Synthetic oligonucleotide
tgtgcacttttaacctgttt

SEQ ID NO: 1763 - DNA, 20 bp, Artificial sequence
  Synthetic oligonucleotide
ttagaacaagcagatctttc

SEQ ID NO: 1764 - DNA, 20 bp, Artificial sequence
  Synthetic oligonucleotide
atagaccaagtgttctagtg

SEQ ID NO: 1765 - DNA, 20 bp, Artificial sequence
  Synthetic oligonucleotide
gagcattccatgtggcatga

SEQ ID NO: 1766 - DNA, 20 bp, Artificial sequence
  Synthetic oligonucleotide
caggcagtggcttcacagtt

SEQ ID NO: 1767 - DNA, 20 bp, Artificial sequence
  Synthetic oligonucleotide
tttcaagcttatttcttgcg

SEQ ID NO: 1768 - DNA, 20 bp, Artificial sequence
  Synthetic oligonucleotide
aaatggcattgcttaggaac

SEQ ID NO: 1769 - DNA, 20 bp, Artificial sequence
  Synthetic oligonucleotide
aagtcaggattattacagaa

SEQ ID NO: 1770 - DNA, 20 bp, Artificial sequence
  Synthetic oligonucleotide
gatattatattcacaatgtc

SEQ ID NO: 1771 - DNA, 20 bp, Artificial sequence
  Synthetic oligonucleotide
ggtccataacactcaagtgt

SEQ ID NO: 1772 - DNA, 20 bp, Artificial sequence
  Synthetic oligonucleotide
gacctgtgcttgtttgtgaa

SEQ ID NO: 1773 - DNA, 20 bp, Artificial sequence
  Synthetic oligonucleotide
tgacctgtgcttgtttgtga

SEQ ID NO: 1774 - DNA, 20 bp, Artificial sequence
  Synthetic oligonucleotide
gtgacctgtgcttgtttgtg

SEQ ID NO: 1775 - DNA, 20 bp, Artificial sequence
  Synthetic oligonucleotide
tgtgacctgtgcttgtttgt

SEQ ID NO: 1776 - DNA, 20 bp, Artificial sequence
  Synthetic oligonucleotide
ctgtgacctgtgcttgtttg

SEQ ID NO: 1777 - DNA, 20 bp, Artificial sequence
  Synthetic oligonucleotide
cctgtgacctgtgcttgttt

SEQ ID NO: 1778 - DNA, 20 bp, Artificial sequence
  Synthetic oligonucleotide
gcctgtgacctgtgcttgtt

SEQ ID NO: 1779 - DNA, 20 bp, Artificial sequence
  Synthetic oligonucleotide
tgcctgtgacctgtgcttgt

SEQ ID NO: 1780 - DNA, 20 bp, Artificial sequence
  Synthetic oligonucleotide
ttgcctgtgacctgtgcttg

SEQ ID NO: 1781 - DNA, 20 bp, Artificial sequence
  Synthetic oligonucleotide
gttgcctgtgacctgtgctt

SEQ ID NO: 1782 - DNA, 20 bp, Artificial sequence
  Synthetic oligonucleotide
tgttgcctgtgacctgtgct

SEQ ID NO: 1783 - DNA, 20 bp, Artificial sequence
  Synthetic oligonucleotide
atgttgcctgtgacctgtgc

SEQ ID NO: 1784 - DNA, 20 bp, Artificial sequence
  Synthetic oligonucleotide
aatgttgcctgtgacctgtg

SEQ ID NO: 1785 - DNA, 20 bp, Artificial sequence
  Synthetic oligonucleotide
aaatgttgcctgtgacctgt

SEQ ID NO: 1786 - DNA, 20 bp, Artificial sequence
  Synthetic oligonucleotide
gaaatgttgcctgtgacctg

SEQ ID NO: 1787 - DNA, 20 bp, Artificial sequence
  Synthetic oligonucleotide
tgaaatgttgcctgtgacct

SEQ ID NO: 1788 - DNA, 20 bp, Artificial sequence
  Synthetic oligonucleotide
ctgaaatgttgcctgtgacc

SEQ ID NO: 1789 - DNA, 20 bp, Artificial sequence
  Synthetic oligonucleotide
ctccagtcctgacatctctt

SEQ ID NO: 1790 - DNA, 20 bp, Artificial sequence
  Synthetic oligonucleotide
acaagaaccaaacttttaat

SEQ ID NO: 1791 - DNA, 20 bp, Artificial sequence
  Synthetic oligonucleotide
caaatcaggcaattcattgt

SEQ ID NO: 1792 - DNA, 20 bp, Artificial sequence
  Synthetic oligonucleotide
aaatcaatcttaaatttttc

SEQ ID NO: 1793 - DNA, 20 bp, Artificial sequence
  Synthetic oligonucleotide
tttatgtaccattagtgggc

SEQ ID NO: 1794 - DNA, 20 bp, Artificial sequence
  Synthetic oligonucleotide
cattagaattcactattcat

SEQ ID NO: 1795 - DNA, 20 bp, Artificial sequence
  Synthetic oligonucleotide
ttaatgaaaacatagcagta

SEQ ID NO: 1796 - DNA, 20 bp, Artificial sequence
  Synthetic oligonucleotide
aaggcaggagccacccatat

SEQ ID NO: 1797 - DNA, 20 bp, Artificial sequence
  Synthetic oligonucleotide
ttctcagagaccacagctgc

SEQ ID NO: 1798 - DNA, 20 bp, Artificial sequence
  Synthetic oligonucleotide
gttctcagagaccacagctg

SEQ ID NO: 1799 - DNA, 20 bp, Artificial sequence
  Synthetic oligonucleotide
tgttctcagagaccacagct

SEQ ID NO: 1800 - DNA, 20 bp, Artificial sequence
  Synthetic oligonucleotide
ttgttctcagagaccacagc

SEQ ID NO: 1801 - DNA, 20 bp, Artificial sequence
  Synthetic oligonucleotide
attgttctcagagaccacag

SEQ ID NO: 1802 - DNA, 20 bp, Artificial sequence
  Synthetic oligonucleotide
tattgttctcagagaccaca

SEQ ID NO: 1803 - DNA, 20 bp, Artificial sequence
  Synthetic oligonucleotide
atattgttctcagagaccac

SEQ ID NO: 1804 - DNA, 20 bp, Artificial sequence
  Synthetic oligonucleotide
catattgttctcagagacca

SEQ ID NO: 1805 - DNA, 20 bp, Artificial sequence
  Synthetic oligonucleotide
ccatattgttctcagagacc

SEQ ID NO: 1806 - DNA, 20 bp, Artificial sequence
  Synthetic oligonucleotide
accatattgttctcagagac

SEQ ID NO: 1807 - DNA, 20 bp, Artificial sequence
  Synthetic oligonucleotide
aaccatattgttctcagaga

SEQ ID NO: 1808 - DNA, 20 bp, Artificial sequence
  Synthetic oligonucleotide
aaaccatattgttctcagag

SEQ ID NO: 1809 - DNA, 20 bp, Artificial sequence
  Synthetic oligonucleotide
caaaccatattgttctcaga

SEQ ID NO: 1810 - DNA, 20 bp, Artificial sequence
  Synthetic oligonucleotide
tgtaacaaaccatattgttc

SEQ ID NO: 1811 - DNA, 20 bp, Artificial sequence
  Synthetic oligonucleotide
caaaaacacaatttaatgta

SEQ ID NO: 1812 - DNA, 20 bp, Artificial sequence
  Synthetic oligonucleotide
gatttgggtggaagtatttg

SEQ ID NO: 1813 - DNA, 20 bp, Artificial sequence
  Synthetic oligonucleotide
cgcaatcagttctttgaata

SEQ ID NO: 1814 - DNA, 20 bp, Artificial sequence
  Synthetic oligonucleotide
caaatatgatttaaacctat

SEQ ID NO: 1815 - DNA, 20 bp, Artificial sequence
  Synthetic oligonucleotide
atgggttcacagaagtgtgg

SEQ ID NO: 1816 - DNA, 20 bp, Artificial sequence
  Synthetic oligonucleotide
acagtatctcattaatgaaa

SEQ ID NO: 1817 - DNA, 20 bp, Artificial sequence
  Synthetic oligonucleotide
ataagtatctcaaaacatca

SEQ ID NO: 1818 - DNA, 20 bp, Artificial sequence
  Synthetic oligonucleotide
aagataaccatatgatgatg

SEQ ID NO: 1819 - DNA, 20 bp, Artificial sequence
  Synthetic oligonucleotide
gtaagatgagtaagtctaaa

SEQ ID NO: 1820 - DNA, 20 bp, Artificial sequence
  Synthetic oligonucleotide
acatataagtgctatttttc

SEQ ID NO: 1821 - DNA, 20 bp, Artificial sequence
  Synthetic oligonucleotide
agggacaaacaggttgttta

SEQ ID NO: 1822 - DNA, 20 bp, Artificial sequence
  Synthetic oligonucleotide
aaagcaaatagcatcatcaa

SEQ ID NO: 1823 - DNA, 20 bp, Artificial sequence
  Synthetic oligonucleotide
ctgtacccttgaatatcacg

SEQ ID NO: 1824 - DNA, 20 bp, Artificial sequence
  Synthetic oligonucleotide
acaattaaattgatgagatg

SEQ ID NO: 1825 - DNA, 20 bp, Artificial sequence
  Synthetic oligonucleotide
cttaaaaatccaaatgttgt

SEQ ID NO: 1826 - DNA, 20 bp, Artificial sequence
  Synthetic oligonucleotide
cattaataagaattaaatgc

SEQ ID NO: 1827 - DNA, 20 bp, Artificial sequence
  Synthetic oligonucleotide
ttctttgcattagtattcac

SEQ ID NO: 1828 - DNA, 20 bp, Artificial sequence
  Synthetic oligonucleotide
attctttgcattagtattca

SEQ ID NO: 1829 - DNA, 20 bp, Artificial sequence
  Synthetic oligonucleotide
tattctttgcattagtattc

SEQ ID NO: 1830 - DNA, 20 bp, Artificial sequence
  Synthetic oligonucleotide
gtattctttgcattagtatt

SEQ ID NO: 1831 - DNA, 20 bp, Artificial sequence
  Synthetic oligonucleotide
agtattctttgcattagtat

SEQ ID NO: 1832 - DNA, 20 bp, Artificial sequence
  Synthetic oligonucleotide
cagtattctttgcattagta

SEQ ID NO: 1833 - DNA, 20 bp, Artificial sequence
  Synthetic oligonucleotide
tcagtattctttgcattagt

SEQ ID NO: 1834 - DNA, 20 bp, Artificial sequence
  Synthetic oligonucleotide
ctcagtattctttgcattag

SEQ ID NO: 1835 - DNA, 20 bp, Artificial sequence
  Synthetic oligonucleotide
gctcagtattctttgcatta

SEQ ID NO: 1836 - DNA, 20 bp, Artificial sequence
  Synthetic oligonucleotide
ggctcagtattctttgcatt

SEQ ID NO: 1837 - DNA, 20 bp, Artificial sequence
  Synthetic oligonucleotide
tggctcagtattctttgcat

SEQ ID NO: 1838 - DNA, 20 bp, Artificial sequence
  Synthetic oligonucleotide
tccattttttcacttacttg

SEQ ID NO: 1839 - DNA, 20 bp, Artificial sequence
  Synthetic oligonucleotide
ttagatttatcatattgttg

SEQ ID NO: 1840 - DNA, 20 bp, Artificial sequence
  Synthetic oligonucleotide
ttaaaatctatttgatttca

SEQ ID NO: 1841 - DNA, 20 bp, Artificial sequence
  Synthetic oligonucleotide
ccaaatagaaaaaaagtgtg

SEQ ID NO: 1842 - DNA, 20 bp, Artificial sequence
  Synthetic oligonucleotide
ctgtatgtacaacctcagaa

SEQ ID NO: 1843 - DNA, 20 bp, Artificial sequence
  Synthetic oligonucleotide
cctgacataagtaggaagca

SEQ ID NO: 1844 - DNA, 20 bp, Artificial sequence
  Synthetic oligonucleotide
cctactttagatatgtcata

SEQ ID NO: 1845 - DNA, 20 bp, Artificial sequence
  Synthetic oligonucleotide
tgttagtatacctttgtagg

SEQ ID NO: 1846 - DNA, 20 bp, Artificial sequence
  Synthetic oligonucleotide
gagggccagctggccatcat

SEQ ID NO: 1847 - DNA, 20 bp, Artificial sequence
  Synthetic oligonucleotide
gaattcaagcccatgccctc

SEQ ID NO: 1848 - DNA, 20 bp, Artificial sequence
  Synthetic oligonucleotide
caacatttttatttcacaga

SEQ ID NO: 1849 - DNA, 20 bp, Artificial sequence
  Synthetic oligonucleotide
gttgccagggatctggcaac

SEQ ID NO: 1850 - DNA, 20 bp, Artificial sequence
  Synthetic oligonucleotide
tgtctgcattatcttatttc

SEQ ID NO: 1851 - DNA, 20 bp, Artificial sequence
  Synthetic oligonucleotide
tgtgatcatgtatcgacaca

SEQ ID NO: 1852 - DNA, 20 bp, Artificial sequence
  Synthetic oligonucleotide
aacggcatgttcagtgatgc

SEQ ID NO: 1853 - DNA, 20 bp, Artificial sequence
  Synthetic oligonucleotide
attataccatgtgcataata

SEQ ID NO: 1854 - DNA, 20 bp, Artificial sequence
  Synthetic oligonucleotide
gcctttgagatttgcttcag

SEQ ID NO: 1855 - DNA, 20 bp, Artificial sequence
  Synthetic oligonucleotide
ttttactgaacacctagaac

SEQ ID NO: 1856 - DNA, 20 bp, Artificial sequence
  Synthetic oligonucleotide
ttcatctaggacctgcaatc

SEQ ID NO: 1857 - DNA, 20 bp, Artificial sequence
  Synthetic oligonucleotide
ttggtgttgtcccaagaaat

SEQ ID NO: 1858 - DNA, 20 bp, Artificial sequence
  Synthetic oligonucleotide
ctgcaatctacttagacctg

SEQ ID NO: 1859 - DNA, 20 bp, Artificial sequence
  Synthetic oligonucleotide
aggaaaaactctgccctcct

SEQ ID NO: 1860 - DNA, 20 bp, Artificial sequence
  Synthetic oligonucleotide
caaatgaacttgggaggagg

SEQ ID NO: 1861 - DNA, 20 bp, Artificial sequence
  Synthetic oligonucleotide
agtgcaggatgaaaccagac

SEQ ID NO: 1862 - DNA, 20 bp, Artificial sequence
  Synthetic oligonucleotide
tgaagtattagagaggatca

SEQ ID NO: 1863 - DNA, 20 bp, Artificial sequence
  Synthetic oligonucleotide
ctcggacggaagtgaaggca

SEQ ID NO: 1864 - DNA, 20 bp, Artificial sequence
  Synthetic oligonucleotide
gctcacttcctgtcaccccc

SEQ ID NO: 1865 - DNA, 20 bp, Artificial sequence
  Synthetic oligonucleotide
taggatgcagcctgaggagc

SEQ ID NO: 1866 - DNA, 20 bp, Artificial sequence
  Synthetic oligonucleotide
cattagagtttgtctctggt

SEQ ID NO: 1867 - DNA, 20 bp, Artificial sequence
  Synthetic oligonucleotide
gaccctttcattacctttca

SEQ ID NO: 1868 - DNA, 20 bp, Artificial sequence
  Synthetic oligonucleotide
tcctagcccacatcttagta

SEQ ID NO: 1869 - DNA, 20 bp, Artificial sequence
  Synthetic oligonucleotide
attgttctgattgatggaca

SEQ ID NO: 1870 - DNA, 20 bp, Artificial sequence
  Synthetic oligonucleotide
tgcgactggtcagagcatgc

SEQ ID NO: 1871 - DNA, 20 bp, Artificial sequence
  Synthetic oligonucleotide
tctagcactatttttttcaa

SEQ ID NO: 1872 - DNA, 20 bp, Artificial sequence
  Synthetic oligonucleotide
ttaataattattctacaaca

SEQ ID NO: 1873 - DNA, 20 bp, Artificial sequence
  Synthetic oligonucleotide
cacatacaggtttttaaaaa

SEQ ID NO: 1874 - DNA, 20 bp, Artificial sequence
  Synthetic oligonucleotide
ccttgtgcatttattccacg

SEQ ID NO: 1875 - DNA, 20 bp, Artificial sequence
  Synthetic oligonucleotide
accttgtgcatttattccac

SEQ ID NO: 1876 - DNA, 20 bp, Artificial sequence
  Synthetic oligonucleotide
taccttgtgcatttattcca

SEQ ID NO: 1877 - DNA, 20 bp, Artificial sequence
  Synthetic oligonucleotide
gtaccttgtgcatttattcc

SEQ ID NO: 1878 - DNA, 20 bp, Artificial sequence
  Synthetic oligonucleotide
agtaccttgtgcatttattc

SEQ ID NO: 1879 - DNA, 20 bp, Artificial sequence
  Synthetic oligonucleotide
gagtaccttgtgcatttatt

SEQ ID NO: 1880 - DNA, 20 bp, Artificial sequence
  Synthetic oligonucleotide
cgaagaattacccagcccaa

SEQ ID NO: 1881 - DNA, 20 bp, Artificial sequence
  Synthetic oligonucleotide
gtgcttgttgccatgctggg

SEQ ID NO: 1882 - DNA, 20 bp, Artificial sequence
  Synthetic oligonucleotide
tgtaatctaggacccagtaa

SEQ ID NO: 1883 - DNA, 20 bp, Artificial sequence
  Synthetic oligonucleotide
ctgtaatctaggacccagta

SEQ ID NO: 1884 - DNA, 20 bp, Artificial sequence
  Synthetic oligonucleotide
actgtaatctaggacccagt

SEQ ID NO: 1885 - DNA, 20 bp, Artificial sequence
  Synthetic oligonucleotide
gactgtaatctaggacccag

SEQ ID NO: 1886 - DNA, 20 bp, Artificial sequence
  Synthetic oligonucleotide
agactgtaatctaggaccca

SEQ ID NO: 1887 - DNA, 20 bp, Artificial sequence
  Synthetic oligonucleotide
cagactgtaatctaggaccc

SEQ ID NO: 1888 - DNA, 20 bp, Artificial sequence
  Synthetic oligonucleotide
ccagactgtaatctaggacc

SEQ ID NO: 1889 - DNA, 20 bp, Artificial sequence
  Synthetic oligonucleotide
tccagactgtaatctaggac

SEQ ID NO: 1890 - DNA, 20 bp, Artificial sequence
  Synthetic oligonucleotide
atccagactgtaatctagga

SEQ ID NO: 1891 - DNA, 20 bp, Artificial sequence
  Synthetic oligonucleotide
aatccagactgtaatctagg

SEQ ID NO: 1892 - DNA, 20 bp, Artificial sequence
  Synthetic oligonucleotide
taatccagactgtaatctag

SEQ ID NO: 1893 - DNA, 20 bp, Artificial sequence
  Synthetic oligonucleotide
aaggaacgcaataatccaga

SEQ ID NO: 1894 - DNA, 20 bp, Artificial sequence
  Synthetic oligonucleotide
accagtgcggaatattgtaa

SEQ ID NO: 1895 - DNA, 20 bp, Artificial sequence
  Synthetic oligonucleotide
atcagtcgaatgaatgtacg

SEQ ID NO: 1896 - DNA, 20 bp, Artificial sequence
  Synthetic oligonucleotide
cagatggatgggtggacaaa

SEQ ID NO: 1897 - DNA, 20 bp, Artificial sequence
  Synthetic oligonucleotide
ttggcattgtattttttttg

SEQ ID NO: 1898 - DNA, 20 bp, Artificial sequence
  Synthetic oligonucleotide
tagactcctacacatattaa

SEQ ID NO: 1899 - DNA, 20 bp, Artificial sequence
  Synthetic oligonucleotide
gatacttcactcagaaaacc

SEQ ID NO: 1900 - DNA, 20 bp, Artificial sequence
  Synthetic oligonucleotide
aaaatggtttgatagttggg

SEQ ID NO: 1901 - DNA, 20 bp, Artificial sequence
  Synthetic oligonucleotide
ttgttaatagttctctgttt

SEQ ID NO: 1902 - DNA, 20 bp, Artificial sequence
  Synthetic oligonucleotide
tttgttaatagttctctgtt

SEQ ID NO: 1903 - DNA, 20 bp, Artificial sequence
  Synthetic oligonucleotide
ttttgttaatagttctctgt

SEQ ID NO: 1904 - DNA, 20 bp, Artificial sequence
  Synthetic oligonucleotide
tttttgttaatagttctctg

SEQ ID NO: 1905 - DNA, 20 bp, Artificial sequence
  Synthetic oligonucleotide
ggataccatacaaccaatta

SEQ ID NO: 1906 - DNA, 20 bp, Artificial sequence
  Synthetic oligonucleotide
acaactaaatcactcaattc

SEQ ID NO: 1907 - DNA, 20 bp, Artificial sequence
  Synthetic oligonucleotide
cagagcccaaaacatttata

SEQ ID NO: 1908 - DNA, 20 bp, Artificial sequence
  Synthetic oligonucleotide
caaatgccttgatcttggag

SEQ ID NO: 1909 - DNA, 20 bp, Artificial sequence
  Synthetic oligonucleotide
gagaacacagcatttggccc

SEQ ID NO: 1910 - DNA, 20 bp, Artificial sequence
  Synthetic oligonucleotide
agaggtaataaagtcacggg

SEQ ID NO: 1911 - DNA, 20 bp, Artificial sequence
  Synthetic oligonucleotide
atatgaaaatgaaaggatgg

SEQ ID NO: 1912 - DNA, 20 bp, Artificial sequence
  Synthetic oligonucleotide
ttacagtttcctatatatcg

SEQ ID NO: 1913 - DNA, 20 bp, Artificial sequence
  Synthetic oligonucleotide
tcatacacaaaataaacaca

SEQ ID NO: 1914 - DNA, 20 bp, Artificial sequence
  Synthetic oligonucleotide
gaatagcagtatgtactaat

SEQ ID NO: 1915 - DNA, 20 bp, Artificial sequence
  Synthetic oligonucleotide
acctttcaataaactgttaa

SEQ ID NO: 1916 - DNA, 20 bp, Artificial sequence
  Synthetic oligonucleotide
attttttcatatatagtgag

SEQ ID NO: 1917 - DNA, 20 bp, Artificial sequence
  Synthetic oligonucleotide
ctgtaacaaatatacatttt

SEQ ID NO: 1918 - DNA, 20 bp, Artificial sequence
  Synthetic oligonucleotide
accaattagtttctaataag

SEQ ID NO: 1919 - DNA, 20 bp, Artificial sequence
  Synthetic oligonucleotide
ttatatacacacacagctac

SEQ ID NO: 1920 - DNA, 20 bp, Artificial sequence
  Synthetic oligonucleotide
ccaaaaatagagatcaatgt

SEQ ID NO: 1921 - DNA, 20 bp, Artificial sequence
  Synthetic oligonucleotide
aaaccactggctaatttttt

SEQ ID NO: 1922 - DNA, 20 bp, Artificial sequence
  Synthetic oligonucleotide
tgagagctatatggctgaaa

SEQ ID NO: 1923 - DNA, 20 bp, Artificial sequence
  Synthetic oligonucleotide
aaaagccttcttagtggtaa

SEQ ID NO: 1924 - DNA, 20 bp, Artificial sequence
  Synthetic oligonucleotide
attactgtgtttcagcagtt

SEQ ID NO: 1925 - DNA, 20 bp, Artificial sequence
  Synthetic oligonucleotide
ttagatataaaaggtatgaa

SEQ ID NO: 1926 - DNA, 20 bp, Artificial sequence
  Synthetic oligonucleotide
ctagcctagggtggtaacag

SEQ ID NO: 1927 - DNA, 20 bp, Artificial sequence
  Synthetic oligonucleotide
tgctcaagaatggactaggt

SEQ ID NO: 1928 - DNA, 20 bp, Artificial sequence
  Synthetic oligonucleotide
tgcatttcattctatgtatg

SEQ ID NO: 1929 - DNA, 20 bp, Artificial sequence
  Synthetic oligonucleotide
agttggagggtggcatacaa

SEQ ID NO: 1930 - DNA, 20 bp, Artificial sequence
  Synthetic oligonucleotide
aacaaacaattcattttcta

SEQ ID NO: 1931 - DNA, 20 bp, Artificial sequence
  Synthetic oligonucleotide
gtctttttaaaattaaaatc

SEQ ID NO: 1932 - DNA, 20 bp, Artificial sequence
  Synthetic oligonucleotide
tataatatacaaaattacta

SEQ ID NO: 1933 - DNA, 20 bp, Artificial sequence
  Synthetic oligonucleotide
caataagtagtgctgttata

SEQ ID NO: 1934 - DNA, 20 bp, Artificial sequence
  Synthetic oligonucleotide
agtagtttttaaatcttcaa

SEQ ID NO: 1935 - DNA, 20 bp, Artificial sequence
  Synthetic oligonucleotide
gtggttctgcccatctgtcc

SEQ ID NO: 1936 - DNA, 20 bp, Artificial sequence
  Synthetic oligonucleotide
tgttttcaagagcgatcgga

SEQ ID NO: 1937 - DNA, 20 bp, Artificial sequence
  Synthetic oligonucleotide
gagtaagtttagatataaaa

SEQ ID NO: 1938 - DNA, 20 bp, Artificial sequence
  Synthetic oligonucleotide
gcataaaaggcagagggagg

SEQ ID NO: 1939 - DNA, 20 bp, Artificial sequence
  Synthetic oligonucleotide
gcaacctttctctccctctc

SEQ ID NO: 1940 - DNA, 20 bp, Artificial sequence
  Synthetic oligonucleotide
ctgaagaaataaataaagaa

SEQ ID NO: 1941 - DNA, 20 bp, Artificial sequence
  Synthetic oligonucleotide
tcaatattcagagatgacta

SEQ ID NO: 1942 - DNA, 20 bp, Artificial sequence
  Synthetic oligonucleotide
cacacccgaaataccacctg

SEQ ID NO: 1943 - DNA, 20 bp, Artificial sequence
  Synthetic oligonucleotide
taagctaaaatggtttcaac

SEQ ID NO: 1944 - DNA, 20 bp, Artificial sequence
  Synthetic oligonucleotide
ggcaaaatttgcattggatg

SEQ ID NO: 1945 - DNA, 20 bp, Artificial sequence
  Synthetic oligonucleotide
tgaaaaaagctatgaccctc

SEQ ID NO: 1946 - DNA, 20 bp, Artificial sequence
  Synthetic oligonucleotide
ttacttctacttttgtgagg

SEQ ID NO: 1947 - DNA, 20 bp, Artificial sequence
  Synthetic oligonucleotide
ccaacattttaaggaaggta

SEQ ID NO: 1948 - DNA, 20 bp, Artificial sequence
  Synthetic oligonucleotide
ggtagagaacacttaagtga

SEQ ID NO: 1949 - DNA, 20 bp, Artificial sequence
  Synthetic oligonucleotide
caaattttaaaagttaactt

SEQ ID NO: 1950 - DNA, 20 bp, Artificial sequence
  Synthetic oligonucleotide
aatttctacaagaaaaatat

SEQ ID NO: 1951 - DNA, 20 bp, Artificial sequence
  Synthetic oligonucleotide
ccagaaagaaacatttagaa

SEQ ID NO: 1952 - DNA, 20 bp, Artificial sequence
  Synthetic oligonucleotide
gtgttaactggcaattccat

SEQ ID NO: 1953 - DNA, 20 bp, Artificial sequence
  Synthetic oligonucleotide
gttcaatgctgtgttaactg

SEQ ID NO: 1954 - DNA, 20 bp, Artificial sequence
  Synthetic oligonucleotide
agttcaatgctgtgttaact

SEQ ID NO: 1955 - DNA, 20 bp, Artificial sequence
  Synthetic oligonucleotide
aagttcaatgctgtgttaac

SEQ ID NO: 1956 - DNA, 20 bp, Artificial sequence
  Synthetic oligonucleotide
aaagttcaatgctgtgttaa

SEQ ID NO: 1957 - DNA, 20 bp, Artificial sequence
  Synthetic oligonucleotide
aaaagttcaatgctgtgtta

SEQ ID NO: 1958 - DNA, 20 bp, Artificial sequence
  Synthetic oligonucleotide
aaaaagttcaatgctgtgtt

SEQ ID NO: 1959 - DNA, 20 bp, Artificial sequence
  Synthetic oligonucleotide
gaaaaagttcaatgctgtgt

SEQ ID NO: 1960 - DNA, 20 bp, Artificial sequence
  Synthetic oligonucleotide
agaaaaagttcaatgctgtg

SEQ ID NO: 1961 - DNA, 20 bp, Artificial sequence
  Synthetic oligonucleotide
aagaaaaagttcaatgctgt

SEQ ID NO: 1962 - DNA, 20 bp, Artificial sequence
  Synthetic oligonucleotide
caagaaaaagttcaatgctg

SEQ ID NO: 1963 - DNA, 20 bp, Artificial sequence
  Synthetic oligonucleotide
acaagaaaaagttcaatgct

SEQ ID NO: 1964 - DNA, 20 bp, Artificial sequence
  Synthetic oligonucleotide
taatatcagccaaagacatt

SEQ ID NO: 1965 - DNA, 20 bp, Artificial sequence
  Synthetic oligonucleotide
ttgaaaaaagtattgactct

SEQ ID NO: 1966 - DNA, 20 bp, Artificial sequence
  Synthetic oligonucleotide
ctgttaaaatgcatttctag

SEQ ID NO: 1967 - DNA, 20 bp, Artificial sequence
  Synthetic oligonucleotide
gtatcccagcactgttggga

SEQ ID NO: 1968 - DNA, 20 bp, Artificial sequence
  Synthetic oligonucleotide
ctggttgctatctagggatc

SEQ ID NO: 1969 - DNA, 20 bp, Artificial sequence
  Synthetic oligonucleotide
aatagaacctaatataattt

SEQ ID NO: 1970 - DNA, 20 bp, Artificial sequence
  Synthetic oligonucleotide
cttctatcctagaattcata

SEQ ID NO: 1971 - DNA, 20 bp, Artificial sequence
  Synthetic oligonucleotide
atgggaatgaggtgtaaaag

SEQ ID NO: 1972 - DNA, 20 bp, Artificial sequence
  Synthetic oligonucleotide
cagtctgataaggagaacaa

SEQ ID NO: 1973 - DNA, 20 bp, Artificial sequence
  Synthetic oligonucleotide
ggatagaatatcaagataaa

SEQ ID NO: 1974 - DNA, 20 bp, Artificial sequence
  Synthetic oligonucleotide
tcacagtgttcttttctctt

SEQ ID NO: 1975 - DNA, 20 bp, Artificial sequence
  Synthetic oligonucleotide
ttgtgctagaatatgagatc

SEQ ID NO: 1976 - DNA, 20 bp, Artificial sequence
  Synthetic oligonucleotide
tctagaattcaagccacacc

SEQ ID NO: 1977 - DNA, 20 bp, Artificial sequence
  Synthetic oligonucleotide
aataatgatagtattttcct

SEQ ID NO: 1978 - DNA, 20 bp, Artificial sequence
  Synthetic oligonucleotide
ccatcacaccttgcagatgt

SEQ ID NO: 1979 - DNA, 20 bp, Artificial sequence
  Synthetic oligonucleotide
acttcctttagagtatacgg

SEQ ID NO: 1980 - DNA, 20 bp, Artificial sequence
  Synthetic oligonucleotide
gcactatataaaatgtaacg

SEQ ID NO: 1981 - DNA, 20 bp, Artificial sequence
  Synthetic oligonucleotide
gttgtaataataatattgac

SEQ ID NO: 1982 - DNA, 20 bp, Artificial sequence
  Synthetic oligonucleotide
ctgtgactttggtctatttg

SEQ ID NO: 1983 - DNA, 20 bp, Artificial sequence
  Synthetic oligonucleotide
ggattgtgtaatagccttta

SEQ ID NO: 1984 - DNA, 20 bp, Artificial sequence
  Synthetic oligonucleotide
tgactatcagtatctgttga

SEQ ID NO: 1985 - DNA, 20 bp, Artificial sequence
  Synthetic oligonucleotide
aagttgacttgtgacataca

SEQ ID NO: 1986 - DNA, 20 bp, Artificial sequence
  Synthetic oligonucleotide
ttctaccgaaggaaatatgt

SEQ ID NO: 1987 - DNA, 20 bp, Artificial sequence
  Synthetic oligonucleotide
agtcattttaataagtgttt

SEQ ID NO: 1988 - DNA, 20 bp, Artificial sequence
  Synthetic oligonucleotide
atcttccaaagttactgtac

SEQ ID NO: 1989 - DNA, 20 bp, Artificial sequence
  Synthetic oligonucleotide
atttcccagtctcgggaact

SEQ ID NO: 1990 - DNA, 20 bp, Artificial sequence
  Synthetic oligonucleotide
gctaatggttttatgtgttt

SEQ ID NO: 1991 - DNA, 20 bp, Artificial sequence
  Synthetic oligonucleotide
catatggtgatatggttagg

SEQ ID NO: 1992 - DNA, 20 bp, Artificial sequence
  Synthetic oligonucleotide
tcattcacctattgaggaac

SEQ ID NO: 1993 - DNA, 20 bp, Artificial sequence
  Synthetic oligonucleotide
ctaagttttctccatgtgtt

SEQ ID NO: 1994 - DNA, 20 bp, Artificial sequence
  Synthetic oligonucleotide
gagccccaggcaatcactga

SEQ ID NO: 1995 - DNA, 20 bp, Artificial sequence
  Synthetic oligonucleotide
ggtcatgtatccaccatgac

SEQ ID NO: 1996 - DNA, 20 bp, Artificial sequence
  Synthetic oligonucleotide
aaataacattgataccttat

SEQ ID NO: 1997 - DNA, 20 bp, Artificial sequence
  Synthetic oligonucleotide
attacagtgcattcccatat

SEQ ID NO: 1998 - DNA, 20 bp, Artificial sequence
  Synthetic oligonucleotide
gggtcttgacttcccaaagt

SEQ ID NO: 1999 - DNA, 20 bp, Artificial sequence
  Synthetic oligonucleotide
tcttttatttcttctgttct

SEQ ID NO: 2000 - DNA, 20 bp, Artificial sequence
  Synthetic oligonucleotide
cgcatctgtctttcttttct

SEQ ID NO: 2001 - DNA, 20 bp, Artificial sequence
  Synthetic oligonucleotide
gtaatctcaccctactgcaa

SEQ ID NO: 2002 - DNA, 20 bp, Artificial sequence
  Synthetic oligonucleotide
tatctagactgagctttaca

SEQ ID NO: 2003 - DNA, 20 bp, Artificial sequence
  Synthetic oligonucleotide
cattcacatatttggattct

SEQ ID NO: 2004 - DNA, 20 bp, Artificial sequence
  Synthetic oligonucleotide
tgaaacattaactgctttat

SEQ ID NO: 2005 - DNA, 20 bp, Artificial sequence
  Synthetic oligonucleotide
acaatgctatgtggaagtta

SEQ ID NO: 2006 - DNA, 20 bp, Artificial sequence
  Synthetic oligonucleotide
cctcagtgctagcgaaggac

SEQ ID NO: 2007 - DNA, 20 bp, Artificial sequence
  Synthetic oligonucleotide
aatttacaatctacacaggc

SEQ ID NO: 2008 - DNA, 20 bp, Artificial sequence
  Synthetic oligonucleotide
tcaattcttgaggccaattg

SEQ ID NO: 2009 - DNA, 20 bp, Artificial sequence
  Synthetic oligonucleotide
tcagtatttcattgtcatac

SEQ ID NO: 2010 - DNA, 20 bp, Artificial sequence
  Synthetic oligonucleotide
gttagtggaattgtaaaata

SEQ ID NO: 2011 - DNA, 20 bp, Artificial sequence
  Synthetic oligonucleotide
ctagttataaaaaacaagat

SEQ ID NO: 2012 - DNA, 20 bp, Artificial sequence
  Synthetic oligonucleotide
ttggccccaatcattggaat

SEQ ID NO: 2013 - DNA, 20 bp, Artificial sequence
  Synthetic oligonucleotide
ttctctgtattggccccaat

SEQ ID NO: 2014 - DNA, 20 bp, Artificial sequence
  Synthetic oligonucleotide
tttctctgtattggccccaa

SEQ ID NO: 2015 - DNA, 20 bp, Artificial sequence
  Synthetic oligonucleotide
ttttctctgtattggcccca

SEQ ID NO: 2016 - DNA, 20 bp, Artificial sequence
  Synthetic oligonucleotide
gttttctctgtattggcccc

SEQ ID NO: 2017 - DNA, 20 bp, Artificial sequence
  Synthetic oligonucleotide
tgttttctctgtattggccc

SEQ ID NO: 2018 - DNA, 20 bp, Artificial sequence
  Synthetic oligonucleotide
atgttttctctgtattggcc

SEQ ID NO: 2019 - DNA, 20 bp, Artificial sequence
  Synthetic oligonucleotide
gatgttttctctgtattggc

SEQ ID NO: 2020 - DNA, 20 bp, Artificial sequence
  Synthetic oligonucleotide
agatgttttctctgtattgg

SEQ ID NO: 2021 - DNA, 20 bp, Artificial sequence
  Synthetic oligonucleotide
gagatgttttctctgtattg

SEQ ID NO: 2022 - DNA, 20 bp, Artificial sequence
  Synthetic oligonucleotide
tgagatgttttctctgtatt

SEQ ID NO: 2023 - DNA, 20 bp, Artificial sequence
  Synthetic oligonucleotide
ttgagatgttttctctgtat

SEQ ID NO: 2024 - DNA, 20 bp, Artificial sequence
  Synthetic oligonucleotide
ttttcagcaggagttataat

SEQ ID NO: 2025 - DNA, 20 bp, Artificial sequence
  Synthetic oligonucleotide
tattccgtgtgtttttccta

SEQ ID NO: 2026 - DNA, 20 bp, Artificial sequence
  Synthetic oligonucleotide
ttttctgataaatggtaatc

SEQ ID NO: 2027 - DNA, 20 bp, Artificial sequence
  Synthetic oligonucleotide
caggtggtatcagtccaaag

SEQ ID NO: 2028 - DNA, 20 bp, Artificial sequence
  Synthetic oligonucleotide
caccacaaagaggaaacagg

SEQ ID NO: 2029 - DNA, 20 bp, Artificial sequence
  Synthetic oligonucleotide
aatgttccctgggagcacaa

SEQ ID NO: 2030 - DNA, 20 bp, Artificial sequence
  Synthetic oligonucleotide
atgtcctgtgcattgtagat

SEQ ID NO: 2031 - DNA, 20 bp, Artificial sequence
  Synthetic oligonucleotide
ttttttaactggatactttg

SEQ ID NO: 2032 - DNA, 20 bp, Artificial sequence
  Synthetic oligonucleotide
attttttaactggatacttt

SEQ ID NO: 2033 - DNA, 20 bp, Artificial sequence
  Synthetic oligonucleotide
cattttttaactggatactt

SEQ ID NO: 2034 - DNA, 20 bp, Artificial sequence
  Synthetic oligonucleotide
acattttttaactggatact

SEQ ID NO: 2035 - DNA, 20 bp, Artificial sequence
  Synthetic oligonucleotide
gacattttttaactggatac

SEQ ID NO: 2036 - DNA, 20 bp, Artificial sequence
  Synthetic oligonucleotide
tgacattttttaactggata

SEQ ID NO: 2037 - DNA, 20 bp, Artificial sequence
  Synthetic oligonucleotide
atgacattttttaactggat

SEQ ID NO: 2038 - DNA, 20 bp, Artificial sequence
  Synthetic oligonucleotide
aatgacattttttaactgga

SEQ ID NO: 2039 - DNA, 20 bp, Artificial sequence
  Synthetic oligonucleotide
taatgacattttttaactgg

SEQ ID NO: 2040 - DNA, 20 bp, Artificial sequence
  Synthetic oligonucleotide
gtaatgacattttttaactg

SEQ ID NO: 2041 - DNA, 20 bp, Artificial sequence
  Synthetic oligonucleotide
agtaatgacattttttaact

SEQ ID NO: 2042 - DNA, 20 bp, Artificial sequence
  Synthetic oligonucleotide
gtgcctggagaagatgaatt

SEQ ID NO: 2043 - DNA, 20 bp, Artificial sequence
  Synthetic oligonucleotide
cttttcctatttggtatttg

SEQ ID NO: 2044 - DNA, 20 bp, Artificial sequence
  Synthetic oligonucleotide
ttgctaaatattactcactc

SEQ ID NO: 2045 - DNA, 20 bp, Artificial sequence
  Synthetic oligonucleotide
accagactgactgtaatatg

SEQ ID NO: 2046 - DNA, 20 bp, Artificial sequence
  Synthetic oligonucleotide
aagtgaaagcattagaggat

SEQ ID NO: 2047 - DNA, 20 bp, Artificial sequence
  Synthetic oligonucleotide
tggtgtgtgcaaacatgtat

SEQ ID NO: 2048 - DNA, 20 bp, Artificial sequence
  Synthetic oligonucleotide
ttgtgagaaagtttttatgg

SEQ ID NO: 2049 - DNA, 20 bp, Artificial sequence
  Synthetic oligonucleotide
ataaatagtcataagactat

SEQ ID NO: 2050 - DNA, 20 bp, Artificial sequence
  Synthetic oligonucleotide
agtgtgatatctaaataaaa

SEQ ID NO: 2051 - DNA, 20 bp, Artificial sequence
  Synthetic oligonucleotide
aattctggtgccaatggtga

SEQ ID NO: 2052 - DNA, 20 bp, Artificial sequence
  Synthetic oligonucleotide
atcatcttatggctaaattt

SEQ ID NO: 2053 - DNA, 20 bp, Artificial sequence
  Synthetic oligonucleotide
atctaggcatgagttgtgtc

SEQ ID NO: 2054 - DNA, 20 bp, Artificial sequence
  Synthetic oligonucleotide
cgtttgaatgaaaaatgacg

SEQ ID NO: 2055 - DNA, 20 bp, Artificial sequence
  Synthetic oligonucleotide
attagaacgaggatggagaa

SEQ ID NO: 2056 - DNA, 20 bp, Artificial sequence
  Synthetic oligonucleotide
agagaattcacatgatagat

SEQ ID NO: 2057 - DNA, 20 bp, Artificial sequence
  Synthetic oligonucleotide
taagaaagaattttaggcat

SEQ ID NO: 2058 - DNA, 20 bp, Artificial sequence
  Synthetic oligonucleotide
gcaggagcaacacagtgaac

SEQ ID NO: 2059 - DNA, 20 bp, Artificial sequence
  Synthetic oligonucleotide
gatcaacaggaaacatttat

SEQ ID NO: 2060 - DNA, 20 bp, Artificial sequence
  Synthetic oligonucleotide
tacccctatatctcaactca

SEQ ID NO: 2061 - DNA, 20 bp, Artificial sequence
  Synthetic oligonucleotide
aatgttatagtttctacatg

SEQ ID NO: 2062 - DNA, 20 bp, Artificial sequence
  Synthetic oligonucleotide
ccaattatgtaattttaaat

SEQ ID NO: 2063 - DNA, 20 bp, Artificial sequence
  Synthetic oligonucleotide
tctcattcaaaaccatcctg

SEQ ID NO: 2064 - DNA, 20 bp, Artificial sequence
  Synthetic oligonucleotide
taattgtcttgagccatgca

SEQ ID NO: 2065 - DNA, 20 bp, Artificial sequence
  Synthetic oligonucleotide
gcttatagtacacattaact

SEQ ID NO: 2066 - DNA, 20 bp, Artificial sequence
  Synthetic oligonucleotide
gccctctctcattaccgtcg

SEQ ID NO: 2067 - DNA, 20 bp, Artificial sequence
  Synthetic oligonucleotide
aatacaaattagttgagtta

SEQ ID NO: 2068 - DNA, 20 bp, Artificial sequence
  Synthetic oligonucleotide
ataccacatactcattttaa

SEQ ID NO: 2069 - DNA, 20 bp, Artificial sequence
  Synthetic oligonucleotide
tagttacatgtagaatgcat

SEQ ID NO: 2070 - DNA, 20 bp, Artificial sequence
  Synthetic oligonucleotide
tctgggatacaaggtgtacc

SEQ ID NO: 2071 - DNA, 20 bp, Artificial sequence
  Synthetic oligonucleotide
cttcatgggaagaaaagcta

SEQ ID NO: 2072 - DNA, 20 bp, Artificial sequence
  Synthetic oligonucleotide
acagaagtacagcatgtaag

SEQ ID NO: 2073 - DNA, 20 bp, Artificial sequence
  Synthetic oligonucleotide
tattaagagtaatgctatcg

SEQ ID NO: 2074 - DNA, 20 bp, Artificial sequence
  Synthetic oligonucleotide
agtagtccattccatttttg

SEQ ID NO: 2075 - DNA, 20 bp, Artificial sequence
  Synthetic oligonucleotide
atttgtcttttctggaatta

SEQ ID NO: 2076 - DNA, 20 bp, Artificial sequence
  Synthetic oligonucleotide
aattctaacaccatcttgga

SEQ ID NO: 2077 - DNA, 20 bp, Artificial sequence
  Synthetic oligonucleotide
ctacattgtggtttttcctt

SEQ ID NO: 2078 - DNA, 20 bp, Artificial sequence
  Synthetic oligonucleotide
ggaagccaagactttcttgt

SEQ ID NO: 2079 - DNA, 20 bp, Artificial sequence
  Synthetic oligonucleotide
gactggcctccagccaatga

SEQ ID NO: 2080 - DNA, 20 bp, Artificial sequence
  Synthetic oligonucleotide
acctcttggatcttttctct

SEQ ID NO: 2081 - DNA, 20 bp, Artificial sequence
  Synthetic oligonucleotide
ttccccaattttcctttgtg

SEQ ID NO: 2082 - DNA, 20 bp, Artificial sequence
  Synthetic oligonucleotide
cactcattttaaatgtacat

SEQ ID NO: 2083 - DNA, 20 bp, Artificial sequence
  Synthetic oligonucleotide
gtcttaggtttatgttcatg

SEQ ID NO: 2084 - DNA, 20 bp, Artificial sequence
  Synthetic oligonucleotide
aatgtcacaagacttcatct

SEQ ID NO: 2085 - DNA, 20 bp, Artificial sequence
  Synthetic oligonucleotide
ccccttgaaaatgtatgtta

SEQ ID NO: 2086 - DNA, 20 bp, Artificial sequence
  Synthetic oligonucleotide
gacctcttaatgtttctttg

SEQ ID NO: 2087 - DNA, 20 bp, Artificial sequence
  Synthetic oligonucleotide
agatcagatcataatcaata

SEQ ID NO: 2088 - DNA, 20 bp, Artificial sequence
  Synthetic oligonucleotide
actagaactgagggacaagg

SEQ ID NO: 2089 - DNA, 20 bp, Artificial sequence
  Synthetic oligonucleotide
attttgggctggaagcagtg

SEQ ID NO: 2090 - DNA, 20 bp, Artificial sequence
  Synthetic oligonucleotide
ggcaggaacaactctgtcag

SEQ ID NO: 2091 - DNA, 20 bp, Artificial sequence
  Synthetic oligonucleotide
agcaccaaccaaccagaggg

SEQ ID NO: 2092 - DNA, 20 bp, Artificial sequence
  Synthetic oligonucleotide
ccctgtcaaattttagaaat

SEQ ID NO: 2093 - DNA, 20 bp, Artificial sequence
  Synthetic oligonucleotide
ttggtctaactgtgttgccc

SEQ ID NO: 2094 - DNA, 20 bp, Artificial sequence
  Synthetic oligonucleotide
gaggattcactaattttttt

SEQ ID NO: 2095 - DNA, 20 bp, Artificial sequence
  Synthetic oligonucleotide
aaaacaaaagagaagcaacc

SEQ ID NO: 2096 - DNA, 20 bp, Artificial sequence
  Synthetic oligonucleotide
gtctctagttttcctaaaat

SEQ ID NO: 2097 - DNA, 20 bp, Artificial sequence
  Synthetic oligonucleotide
aggatactcaatctcttaat

SEQ ID NO: 2098 - DNA, 20 bp, Artificial sequence
  Synthetic oligonucleotide
cgaatagaaaaatttaactt

SEQ ID NO: 2099 - DNA, 20 bp, Artificial sequence
  Synthetic oligonucleotide
cttcaattaatattccaaga

SEQ ID NO: 2100 - DNA, 20 bp, Artificial sequence
  Synthetic oligonucleotide
cactgtggatgaaggttact

SEQ ID NO: 2101 - DNA, 20 bp, Artificial sequence
  Synthetic oligonucleotide
ggactacttgatgtctagat

SEQ ID NO: 2102 - DNA, 20 bp, Artificial sequence
  Synthetic oligonucleotide
tttaataatacagtattatt

SEQ ID NO: 2103 - DNA, 20 bp, Artificial sequence
  Synthetic oligonucleotide
aacctacagagagtggactt

SEQ ID NO: 2104 - DNA, 20 bp, Artificial sequence
  Synthetic oligonucleotide
tttatttcccacataaaatt

SEQ ID NO: 2105 - DNA, 20 bp, Artificial sequence
  Synthetic oligonucleotide
tacttaagagaaaaaatagt

SEQ ID NO: 2106 - DNA, 20 bp, Artificial sequence
  Synthetic oligonucleotide
ccaagtaaatagtattttgg

SEQ ID NO: 2107 - DNA, 20 bp, Artificial sequence
  Synthetic oligonucleotide
ttccatgaagccaagtaaat

SEQ ID NO: 2108 - DNA, 20 bp, Artificial sequence
  Synthetic oligonucleotide
tttccatgaagccaagtaaa

SEQ ID NO: 2109 - DNA, 20 bp, Artificial sequence
  Synthetic oligonucleotide
atttccatgaagccaagtaa

SEQ ID NO: 2110 - DNA, 20 bp, Artificial sequence
  Synthetic oligonucleotide
gatttccatgaagccaagta

SEQ ID NO: 2111 - DNA, 20 bp, Artificial sequence
  Synthetic oligonucleotide
agatttccatgaagccaagt

SEQ ID NO: 2112 - DNA, 20 bp, Artificial sequence
  Synthetic oligonucleotide
gagatttccatgaagccaag

SEQ ID NO: 2113 - DNA, 20 bp, Artificial sequence
  Synthetic oligonucleotide
agagatttccatgaagccaa

SEQ ID NO: 2114 - DNA, 20 bp, Artificial sequence
  Synthetic oligonucleotide
gagagatttccatgaagcca

SEQ ID NO: 2115 - DNA, 20 bp, Artificial sequence
  Synthetic oligonucleotide
agagagatttccatgaagcc

SEQ ID NO: 2116 - DNA, 20 bp, Artificial sequence
  Synthetic oligonucleotide
gagagagatttccatgaagc

SEQ ID NO: 2117 - DNA, 20 bp, Artificial sequence
  Synthetic oligonucleotide
tgagagagatttccatgaag

SEQ ID NO: 2118 - DNA, 20 bp, Artificial sequence
  Synthetic oligonucleotide
gtgagagagatttccatgaa

SEQ ID NO: 2119 - DNA, 20 bp, Artificial sequence
  Synthetic oligonucleotide
agtgagagagatttccatga

SEQ ID NO: 2120 - DNA, 20 bp, Artificial sequence
  Synthetic oligonucleotide
ggatttatgtaacaggaata

SEQ ID NO: 2121 - DNA, 20 bp, Artificial sequence
  Synthetic oligonucleotide
tgatttaatacatatttgca

SEQ ID NO: 2122 - DNA, 20 bp, Artificial sequence
  Synthetic oligonucleotide
tccacacttccctcgatact

SEQ ID NO: 2123 - DNA, 20 bp, Artificial sequence
  Synthetic oligonucleotide
gtggtggtgccagcagtggg

SEQ ID NO: 2124 - DNA, 20 bp, Artificial sequence
  Synthetic oligonucleotide
taccacccacagctgtgccc

SEQ ID NO: 2125 - DNA, 20 bp, Artificial sequence
  Synthetic oligonucleotide
tagaatagtgcctgtttaaa

SEQ ID NO: 2126 - DNA, 20 bp, Artificial sequence
  Synthetic oligonucleotide
aattgccttttctgtttctt

SEQ ID NO: 2127 - DNA, 20 bp, Artificial sequence
  Synthetic oligonucleotide
tactagcatagtgtctagca

SEQ ID NO: 2128 - DNA, 20 bp, Artificial sequence
  Synthetic oligonucleotide
atactcagacatcttaagtc

SEQ ID NO: 2129 - DNA, 20 bp, Artificial sequence
  Synthetic oligonucleotide
gatgcctgacacaaaatagg

SEQ ID NO: 2130 - DNA, 20 bp, Artificial sequence
  Synthetic oligonucleotide
attatattttgcctaacctc

SEQ ID NO: 2131 - DNA, 20 bp, Artificial sequence
  Synthetic oligonucleotide
gagaaaatctgtctccttgc

SEQ ID NO: 2132 - DNA, 20 bp, Artificial sequence
  Synthetic oligonucleotide
cattgtgggattgtaagtct

SEQ ID NO: 2133 - DNA, 20 bp, Artificial sequence
  Synthetic oligonucleotide
tcacaattacattttcttgt

SEQ ID NO: 2134 - DNA, 20 bp, Artificial sequence
  Synthetic oligonucleotide
tatagcatgaattactttac

SEQ ID NO: 2135 - DNA, 20 bp, Artificial sequence
  Synthetic oligonucleotide
tacctcctcttcagcaagga

SEQ ID NO: 2136 - DNA, 20 bp, Artificial sequence
  Synthetic oligonucleotide
cctcttgtagtttttaaaat

SEQ ID NO: 2137 - DNA, 20 bp, Artificial sequence
  Synthetic oligonucleotide
ttggttgttcaagtgattct

SEQ ID NO: 2138 - DNA, 20 bp, Artificial sequence
  Synthetic oligonucleotide
tctcacagttttgttgttgt

SEQ ID NO: 2139 - DNA, 20 bp, Artificial sequence
  Synthetic oligonucleotide
cttttcatcatgcctttatt

SEQ ID NO: 2140 - DNA, 20 bp, Artificial sequence
  Synthetic oligonucleotide
tcttttcatcatgcctttat

SEQ ID NO: 2141 - DNA, 20 bp, Artificial sequence
  Synthetic oligonucleotide
atcttttcatcatgccttta

SEQ ID NO: 2142 - DNA, 20 bp, Artificial sequence
  Synthetic oligonucleotide
gatcttttcatcatgccttt

SEQ ID NO: 2143 - DNA, 20 bp, Artificial sequence
  Synthetic oligonucleotide
tgatcttttcatcatgcctt

SEQ ID NO: 2144 - DNA, 20 bp, Artificial sequence
  Synthetic oligonucleotide
ttgatcttttcatcatgcct

SEQ ID NO: 2145 - DNA, 20 bp, Artificial sequence
  Synthetic oligonucleotide
cttgatcttttcatcatgcc

SEQ ID NO: 2146 - DNA, 20 bp, Artificial sequence
  Synthetic oligonucleotide
tcttgatcttttcatcatgc

SEQ ID NO: 2147 - DNA, 20 bp, Artificial sequence
  Synthetic oligonucleotide
ctcttgatcttttcatcatg

SEQ ID NO: 2148 - DNA, 20 bp, Artificial sequence
  Synthetic oligonucleotide
tctcttgatcttttcatcat

SEQ ID NO: 2149 - DNA, 20 bp, Artificial sequence
  Synthetic oligonucleotide
atctcttgatcttttcatca

SEQ ID NO: 2150 - DNA, 20 bp, Artificial sequence
  Synthetic oligonucleotide
ggattactcctggcacagct

SEQ ID NO: 2151 - DNA, 20 bp, Artificial sequence
  Synthetic oligonucleotide
cgatggagtacctaccaact

SEQ ID NO: 2152 - DNA, 20 bp, Artificial sequence
  Synthetic oligonucleotide
tacgagtagaagtgacttgc

SEQ ID NO: 2153 - DNA, 20 bp, Artificial sequence
  Synthetic oligonucleotide
tcagtggagagctatgcaat

SEQ ID NO: 2154 - DNA, 20 bp, Artificial sequence
  Synthetic oligonucleotide
tgtagaatacttattttttg

SEQ ID NO: 2155 - DNA, 20 bp, Artificial sequence
  Synthetic oligonucleotide
attttggatgcttctgaaga

SEQ ID NO: 2156 - DNA, 20 bp, Artificial sequence
  Synthetic oligonucleotide
tattttggatgcttctgaag

SEQ ID NO: 2157 - DNA, 20 bp, Artificial sequence
  Synthetic oligonucleotide
gtattttggatgcttctgaa

SEQ ID NO: 2158 - DNA, 20 bp, Artificial sequence
  Synthetic oligonucleotide
tgtattttggatgcttctga

SEQ ID NO: 2159 - DNA, 20 bp, Artificial sequence
  Synthetic oligonucleotide
ttgtattttggatgcttctg

SEQ ID NO: 2160 - DNA, 20 bp, Artificial sequence
  Synthetic oligonucleotide
tttgtattttggatgcttct

SEQ ID NO: 2161 - DNA, 20 bp, Artificial sequence
  Synthetic oligonucleotide
gtttgtattttggatgcttc

SEQ ID NO: 2162 - DNA, 20 bp, Artificial sequence
  Synthetic oligonucleotide
ggtttgtattttggatgctt

SEQ ID NO: 2163 - DNA, 20 bp, Artificial sequence
  Synthetic oligonucleotide
tggtttgtattttggatgct

SEQ ID NO: 2164 - DNA, 20 bp, Artificial sequence
  Synthetic oligonucleotide
atggtttgtattttggatgc

SEQ ID NO: 2165 - DNA, 20 bp, Artificial sequence
  Synthetic oligonucleotide
gatggtttgtattttggatg

SEQ ID NO: 2166 - DNA, 20 bp, Artificial sequence
  Synthetic oligonucleotide
acgacattttcttgcctctt

SEQ ID NO: 2167 - DNA, 20 bp, Artificial sequence
  Synthetic oligonucleotide
atgctttcacttgaaaaaaa

SEQ ID NO: 2168 - DNA, 20 bp, Artificial sequence
  Synthetic oligonucleotide
ctttttttatttaaattctt

SEQ ID NO: 2169 - DNA, 20 bp, Artificial sequence
  Synthetic oligonucleotide
atggagaaactacccccatg

SEQ ID NO: 2170 - DNA, 20 bp, Artificial sequence
  Synthetic oligonucleotide
acctcacatggcaggagaaa

SEQ ID NO: 2171 - DNA, 20 bp, Artificial sequence
  Synthetic oligonucleotide
tttttataaagaaagaagtt

SEQ ID NO: 2172 - DNA, 20 bp, Artificial sequence
  Synthetic oligonucleotide
tcttgcttctatgttatatg

SEQ ID NO: 2173 - DNA, 20 bp, Artificial sequence
  Synthetic oligonucleotide
cacccaccataaaaggtgat

SEQ ID NO: 2174 - DNA, 20 bp, Artificial sequence
  Synthetic oligonucleotide
tgcctctgtttacaaagcaa

SEQ ID NO: 2175 - DNA, 20 bp, Artificial sequence
  Synthetic oligonucleotide
tggtttcctttggtggcttt

SEQ ID NO: 2176 - DNA, 20 bp, Artificial sequence
  Synthetic oligonucleotide
tttccttaagaggagctctc

SEQ ID NO: 2177 - DNA, 20 bp, Artificial sequence
  Synthetic oligonucleotide
gatgtaagtgagacagctca

SEQ ID NO: 2178 - DNA, 20 bp, Artificial sequence
  Synthetic oligonucleotide
tttaggtaatggtttggtat

SEQ ID NO: 2179 - DNA, 20 bp, Artificial sequence
  Synthetic oligonucleotide
atagaggttattattcagta

SEQ ID NO: 2180 - DNA, 20 bp, Artificial sequence
  Synthetic oligonucleotide
aggaaaaccatctctgctat

SEQ ID NO: 2181 - DNA, 20 bp, Artificial sequence
  Synthetic oligonucleotide
ggaaagaggtatgagtgatg

SEQ ID NO: 2182 - DNA, 20 bp, Artificial sequence
  Synthetic oligonucleotide
gagtgctgcctaagtcttgg

SEQ ID NO: 2183 - DNA, 20 bp, Artificial sequence
  Synthetic oligonucleotide
ttgctagctaaaaggagggt

SEQ ID NO: 2184 - DNA, 20 bp, Artificial sequence
  Synthetic oligonucleotide
ccagttctagttgtactagt

SEQ ID NO: 2185 - DNA, 20 bp, Artificial sequence
  Synthetic oligonucleotide
aaaatgaacttttttattcg

SEQ ID NO: 2186 - DNA, 20 bp, Artificial sequence
  Synthetic oligonucleotide
tgcacatcttttgcctgaaa

SEQ ID NO: 2187 - DNA, 20 bp, Artificial sequence
  Synthetic oligonucleotide
aactaatcattattttagac

SEQ ID NO: 2188 - DNA, 20 bp, Artificial sequence
  Synthetic oligonucleotide
catcaatatctgcaataata

SEQ ID NO: 2189 - DNA, 20 bp, Artificial sequence
  Synthetic oligonucleotide
tcatcaatatctgcaataat

SEQ ID NO: 2190 - DNA, 20 bp, Artificial sequence
  Synthetic oligonucleotide
ttcatcaatatctgcaataa

SEQ ID NO: 2191 - DNA, 20 bp, Artificial sequence
  Synthetic oligonucleotide
tttcatcaatatctgcaata

SEQ ID NO: 2192 - DNA, 20 bp, Artificial sequence
  Synthetic oligonucleotide
ttttcatcaatatctgcaat

SEQ ID NO: 2193 - DNA, 20 bp, Artificial sequence
  Synthetic oligonucleotide
gttttcatcaatatctgcaa

SEQ ID NO: 2194 - DNA, 20 bp, Artificial sequence
  Synthetic oligonucleotide
ggttttcatcaatatctgca

SEQ ID NO: 2195 - DNA, 20 bp, Artificial sequence
  Synthetic oligonucleotide
aggttttcatcaatatctgc

SEQ ID NO: 2196 - DNA, 20 bp, Artificial sequence
  Synthetic oligonucleotide
aaggttttcatcaatatctg

SEQ ID NO: 2197 - DNA, 20 bp, Artificial sequence
  Synthetic oligonucleotide
aaaggttttcatcaatatct

SEQ ID NO: 2198 - DNA, 20 bp, Artificial sequence
  Synthetic oligonucleotide
taaaggttttcatcaatatc

SEQ ID NO: 2199 - DNA, 20 bp, Artificial sequence
  Synthetic oligonucleotide
gtaaaggttttcatcaatat

SEQ ID NO: 2200 - DNA, 20 bp, Artificial sequence
  Synthetic oligonucleotide
aattaagaggaaggtaaagg

SEQ ID NO: 2201 - DNA, 20 bp, Artificial sequence
  Synthetic oligonucleotide
aaataatttcaacatcagtt

SEQ ID NO: 2202 - DNA, 20 bp, Artificial sequence
  Synthetic oligonucleotide
caatagcttgccaaaaattc

SEQ ID NO: 2203 - DNA, 20 bp, Artificial sequence
  Synthetic oligonucleotide
attttgtttcatggatgttt

SEQ ID NO: 2204 - DNA, 20 bp, Artificial sequence
  Synthetic oligonucleotide
agtcaacataattttttttg

SEQ ID NO: 2205 - DNA, 20 bp, Artificial sequence
  Synthetic oligonucleotide
tcaacaaggccttacttacg

SEQ ID NO: 2206 - DNA, 20 bp, Artificial sequence
  Synthetic oligonucleotide
ttataaaatatcttcctagg

SEQ ID NO: 2207 - DNA, 20 bp, Artificial sequence
  Synthetic oligonucleotide
ttttggctgcctctcaaaat

SEQ ID NO: 2208 - DNA, 20 bp, Artificial sequence
  Synthetic oligonucleotide
ttcattaaaaattctgagtt

SEQ ID NO: 2209 - DNA, 20 bp, Artificial sequence
  Synthetic oligonucleotide
atttttaatataatgctacg

SEQ ID NO: 2210 - DNA, 20 bp, Artificial sequence
  Synthetic oligonucleotide
caccagtgtttgcatgtccc

SEQ ID NO: 2211 - DNA, 20 bp, Artificial sequence
  Synthetic oligonucleotide
cctcctacttcctaggctgc

SEQ ID NO: 2212 - DNA, 20 bp, Artificial sequence
  Synthetic oligonucleotide
gctcaattgggtgttcagca

SEQ ID NO: 2213 - DNA, 20 bp, Artificial sequence
  Synthetic oligonucleotide
acactgtaaaactgtcacaa

SEQ ID NO: 2214 - DNA, 20 bp, Artificial sequence
  Synthetic oligonucleotide
cacatggatgtatttgtgcg

SEQ ID NO: 2215 - DNA, 20 bp, Artificial sequence
  Synthetic oligonucleotide
agaagtttcaagaacagtca

SEQ ID NO: 2216 - DNA, 20 bp, Artificial sequence
  Synthetic oligonucleotide
tttaatatacagatgttcag

SEQ ID NO: 2217 - DNA, 20 bp, Artificial sequence
  Synthetic oligonucleotide
cccacctgccaaaaacacct

SEQ ID NO: 2218 - DNA, 20 bp, Artificial sequence
  Synthetic oligonucleotide
tcgaagtgggtatggatgca

SEQ ID NO: 2219 - DNA, 20 bp, Artificial sequence
  Synthetic oligonucleotide
gggcatatggctatatacta

SEQ ID NO: 2220 - DNA, 20 bp, Artificial sequence
  Synthetic oligonucleotide
tctagttagcatctatccac

SEQ ID NO: 2221 - DNA, 20 bp, Artificial sequence
  Synthetic oligonucleotide
tcttataaaatttctatact

SEQ ID NO: 2222 - DNA, 20 bp, Artificial sequence
  Synthetic oligonucleotide
tcattttacttaagtggcac

SEQ ID NO: 2223 - DNA, 20 bp, Artificial sequence
  Synthetic oligonucleotide
gtctttttcccatccttgac

SEQ ID NO: 2224 - DNA, 20 bp, Artificial sequence
  Synthetic oligonucleotide
ttagcaagtataaatatgtt

SEQ ID NO: 2225 - DNA, 20 bp, Artificial sequence
  Synthetic oligonucleotide
tagttgattgtaggaaatgt

SEQ ID NO: 2226 - DNA, 20 bp, Artificial sequence
  Synthetic oligonucleotide
ttgcaaaacagatggacttc

SEQ ID NO: 2227 - DNA, 20 bp, Artificial sequence
  Synthetic oligonucleotide
tgatgatctagccaagaggg

SEQ ID NO: 2228 - DNA, 20 bp, Artificial sequence
  Synthetic oligonucleotide
acaagctgtacattaattac

SEQ ID NO: 2229 - DNA, 20 bp, Artificial sequence
  Synthetic oligonucleotide
ttccatgaagccaagatcaa

SEQ ID NO: 2230 - DNA, 20 bp, Artificial sequence
  Synthetic oligonucleotide
tttccatgaagccaagatca

SEQ ID NO: 2231 - DNA, 20 bp, Artificial sequence
  Synthetic oligonucleotide
atttccatgaagccaagatc

SEQ ID NO: 2232 - DNA, 20 bp, Artificial sequence
  Synthetic oligonucleotide
tatttccatgaagccaagat

SEQ ID NO: 2233 - DNA, 20 bp, Artificial sequence
  Synthetic oligonucleotide
ttatttccatgaagccaaga

SEQ ID NO: 2234 - DNA, 20 bp, Artificial sequence
  Synthetic oligonucleotide
attatttccatgaagccaag

SEQ ID NO: 2235 - DNA, 20 bp, Artificial sequence
  Synthetic oligonucleotide
aattatttccatgaagccaa

SEQ ID NO: 2236 - DNA, 20 bp, Artificial sequence
  Synthetic oligonucleotide
gaattatttccatgaagcca

SEQ ID NO: 2237 - DNA, 20 bp, Artificial sequence
  Synthetic oligonucleotide
tgaattatttccatgaagcc

SEQ ID NO: 2238 - DNA, 20 bp, Artificial sequence
  Synthetic oligonucleotide
gtgaattatttccatgaagc

SEQ ID NO: 2239 - DNA, 20 bp, Artificial sequence
  Synthetic oligonucleotide
agtgaattatttccatgaag

SEQ ID NO: 2240 - DNA, 20 bp, Artificial sequence
  Synthetic oligonucleotide
aagtaagttctgagctgaca

SEQ ID NO: 2241 - DNA, 20 bp, Artificial sequence
  Synthetic oligonucleotide
tattaagtctgttaagaggt

SEQ ID NO: 2242 - DNA, 20 bp, Artificial sequence
  Synthetic oligonucleotide
atgttgtatgatgctctggc

SEQ ID NO: 2243 - DNA, 20 bp, Artificial sequence
  Synthetic oligonucleotide
gtagattgctattttgccac

SEQ ID NO: 2244 - DNA, 20 bp, Artificial sequence
  Synthetic oligonucleotide
aatgggtttatgtataatcg

SEQ ID NO: 2245 - DNA, 20 bp, Artificial sequence
  Synthetic oligonucleotide
ctccagacatagatctctct

SEQ ID NO: 2246 - DNA, 20 bp, Artificial sequence
  Synthetic oligonucleotide
acaagtaaactgaaaccaga

SEQ ID NO: 2247 - DNA, 20 bp, Artificial sequence
  Synthetic oligonucleotide
gtaaggatgatcattataac

SEQ ID NO: 2248 - DNA, 20 bp, Artificial sequence
  Synthetic oligonucleotide
attaaacatttttaatagcc

SEQ ID NO: 2249 - DNA, 20 bp, Artificial sequence
  Synthetic oligonucleotide
aggtgaataaacttcgaaat

SEQ ID NO: 2250 - DNA, 20 bp, Artificial sequence
  Synthetic oligonucleotide
tatcaaaagattatatatag

SEQ ID NO: 2251 - DNA, 20 bp, Artificial sequence
  Synthetic oligonucleotide
taaataacatgaataagacc

SEQ ID NO: 2252 - DNA, 20 bp, Artificial sequence
  Synthetic oligonucleotide
ttttacacataagcatatat

SEQ ID NO: 2253 - DNA, 20 bp, Artificial sequence
  Synthetic oligonucleotide
aatgaatgttaccattttat

SEQ ID NO: 2254 - DNA, 20 bp, Artificial sequence
  Synthetic oligonucleotide
caatatatttattaggagaa

SEQ ID NO: 2255 - DNA, 20 bp, Artificial sequence
  Synthetic oligonucleotide
tcataaatcagtcctctata

SEQ ID NO: 2256 - DNA, 20 bp, Artificial sequence
  Synthetic oligonucleotide
aaaaagaagtcagatatttc

SEQ ID NO: 2257 - DNA, 20 bp, Artificial sequence
  Synthetic oligonucleotide
tttcggcagaattccagaga

SEQ ID NO: 2258 - DNA, 20 bp, Artificial sequence
  Synthetic oligonucleotide
tggttttctttttctagtca

SEQ ID NO: 2259 - DNA, 20 bp, Artificial sequence
  Synthetic oligonucleotide
ctcacaaatcataggtttgt

SEQ ID NO: 2260 - DNA, 20 bp, Artificial sequence
  Synthetic oligonucleotide
gactatcaatcggtacttat

SEQ ID NO: 2261 - DNA, 20 bp, Artificial sequence
  Synthetic oligonucleotide
attttatttgaaatatgtga

SEQ ID NO: 2262 - DNA, 20 bp, Artificial sequence
  Synthetic oligonucleotide
gatcttagaaattcatttag

SEQ ID NO: 2263 - DNA, 20 bp, Artificial sequence
  Synthetic oligonucleotide
ttctctaagtacaacactgc

SEQ ID NO: 2264 - DNA, 20 bp, Artificial sequence
  Synthetic oligonucleotide
ccacagttacatctggaaac

SEQ ID NO: 2265 - DNA, 20 bp, Artificial sequence
  Synthetic oligonucleotide
aagttgtgcgactttgggca

SEQ ID NO: 2266 - DNA, 20 bp, Artificial sequence
  Synthetic oligonucleotide
tatcatcagcagaacataga

SEQ ID NO: 2267 - DNA, 20 bp, Artificial sequence
  Synthetic oligonucleotide
taaatattgttttttctaag

SEQ ID NO: 2268 - DNA, 20 bp, Artificial sequence
  Synthetic oligonucleotide
gacacatttatattagatgt

SEQ ID NO: 2269 - DNA, 20 bp, Artificial sequence
  Synthetic oligonucleotide
aaggagggaaacaaagctcc

SEQ ID NO: 2270 - DNA, 20 bp, Artificial sequence
  Synthetic oligonucleotide
tactatatgacatgctttct

SEQ ID NO: 2271 - DNA, 20 bp, Artificial sequence
  Synthetic oligonucleotide
caatggatgaataggtggat

SEQ ID NO: 2272 - DNA, 20 bp, Artificial sequence
  Synthetic oligonucleotide
atgttgtggcttaaccccat

SEQ ID NO: 2273 - DNA, 20 bp, Artificial sequence
  Synthetic oligonucleotide
aaaaaacctgaagtacaaca

SEQ ID NO: 2274 - DNA, 20 bp, Artificial sequence
  Synthetic oligonucleotide
tactgtgggtcattttttct

SEQ ID NO: 2275 - DNA, 20 bp, Artificial sequence
  Synthetic oligonucleotide
ataatatctatatttaaaac

SEQ ID NO: 2276 - DNA, 20 bp, Artificial sequence
  Synthetic oligonucleotide
tataaagatggatttttaaa

SEQ ID NO: 2277 - DNA, 20 bp, Artificial sequence
  Synthetic oligonucleotide
aaatggatgctaagacaatt

SEQ ID NO: 2278 - DNA, 20 bp, Artificial sequence
  Synthetic oligonucleotide
ccttctctaactgcctttac

SEQ ID NO: 2279 - DNA, 20 bp, Artificial sequence
  Synthetic oligonucleotide
gtatagttaaagctacattt

SEQ ID NO: 2280 - DNA, 20 bp, Artificial sequence
  Synthetic oligonucleotide
caaattttgcttttacaccc

SEQ ID NO: 2281 - DNA, 20 bp, Artificial sequence
  Synthetic oligonucleotide
cttacttgagctaggtgatc

SEQ ID NO: 2282 - DNA, 20 bp, Artificial sequence
  Synthetic oligonucleotide
ttcctctatttaatgtattt

SEQ ID NO: 2283 - DNA, 20 bp, Artificial sequence
  Synthetic oligonucleotide
tagcagttccaggttccaca

SEQ ID NO: 2284 - DNA, 20 bp, Artificial sequence
  Synthetic oligonucleotide
atcactttggtgtgagaaga

SEQ ID NO: 2285 - DNA, 20 bp, Artificial sequence
  Synthetic oligonucleotide
attccatagacttccaagtc

SEQ ID NO: 2286 - DNA, 20 bp, Artificial sequence
  Synthetic oligonucleotide
agcatccacatgaaattggt

SEQ ID NO: 2287 - DNA, 20 bp, Artificial sequence
  Synthetic oligonucleotide
gatgtcttgataccttcaga

SEQ ID NO: 2288 - DNA, 20 bp, Artificial sequence
  Synthetic oligonucleotide
ctacatgctaaacttgtttt

SEQ ID NO: 2289 - DNA, 20 bp, Artificial sequence
  Synthetic oligonucleotide
gtgagaataaatgtgatcta

SEQ ID NO: 2290 - DNA, 20 bp, Artificial sequence
  Synthetic oligonucleotide
ctgtttcattaggaattttt

SEQ ID NO: 2291 - DNA, 20 bp, Artificial sequence
  Synthetic oligonucleotide
tttatgtacatggccagaaa

SEQ ID NO: 2292 - DNA, 20 bp, Artificial sequence
  Synthetic oligonucleotide
acaaaaaatttcctaacatt

SEQ ID NO: 2293 - DNA, 20 bp, Artificial sequence
  Synthetic oligonucleotide
tgtagcatttacctaacagc

SEQ ID NO: 2294 - DNA, 20 bp, Artificial sequence
  Synthetic oligonucleotide
agtgcagaatcctgattgca

SEQ ID NO: 2295 - DNA, 20 bp, Artificial sequence
  Synthetic oligonucleotide
cacattgtaacataagctgt

SEQ ID NO: 2296 - DNA, 20 bp, Artificial sequence
  Synthetic oligonucleotide
agtttgaactccgcccaaga

SEQ ID NO: 2297 - DNA, 20 bp, Artificial sequence
  Synthetic oligonucleotide
acaaggtttgcacaaataaa

SEQ ID NO: 2298 - DNA, 20 bp, Artificial sequence
  Synthetic oligonucleotide
cctcatatatagggcctcac

SEQ ID NO: 2299 - DNA, 20 bp, Artificial sequence
  Synthetic oligonucleotide
aattataaagccctgaaggc

SEQ ID NO: 2300 - DNA, 20 bp, Artificial sequence
  Synthetic oligonucleotide
aatgtattgttatttgtcat

SEQ ID NO: 2301 - DNA, 20 bp, Artificial sequence
  Synthetic oligonucleotide
caacttctccatataaccaa

SEQ ID NO: 2302 - DNA, 20 bp, Artificial sequence
  Synthetic oligonucleotide
ctaaaggatgcaaaggcata

SEQ ID NO: 2303 - DNA, 20 bp, Artificial sequence
  Synthetic oligonucleotide
cgtagatagagttggagacc

SEQ ID NO: 2304 - DNA, 20 bp, Artificial sequence
  Synthetic oligonucleotide
gtgatatatttacatatata

SEQ ID NO: 2305 - DNA, 20 bp, Artificial sequence
  Synthetic oligonucleotide
ttccagcgatcccactccta

SEQ ID NO: 2306 - DNA, 20 bp, Artificial sequence
  Synthetic oligonucleotide
tttttttacactgctggtag

SEQ ID NO: 2307 - DNA, 20 bp, Artificial sequence
  Synthetic oligonucleotide
tttaatgaccagggaaatgc

SEQ ID NO: 2308 - DNA, 20 bp, Artificial sequence
  Synthetic oligonucleotide
gggacctaaaactataaagc

SEQ ID NO: 2309 - DNA, 20 bp, Artificial sequence
  Synthetic oligonucleotide
caaaaccttaaaaattatag

SEQ ID NO: 2310 - DNA, 20 bp, Artificial sequence
  Synthetic oligonucleotide
aaatccagaaataaagctaa

SEQ ID NO: 2311 - DNA, 20 bp, Artificial sequence
  Synthetic oligonucleotide
ctagattacccaacttcaaa

SEQ ID NO: 2312 - DNA, 20 bp, Artificial sequence
  Synthetic oligonucleotide
gactcccatcaaaatgccac

SEQ ID NO: 2313 - DNA, 20 bp, Artificial sequence
  Synthetic oligonucleotide
acagaaactaatgaaaacac

SEQ ID NO: 2314 - DNA, 20 bp, Artificial sequence
  Synthetic oligonucleotide
gagcctttttacaacagctg

SEQ ID NO: 2315 - DNA, 20 bp, Artificial sequence
  Synthetic oligonucleotide
ttaattcagtaaagtttcca

SEQ ID NO: 2316 - DNA, 20 bp, Artificial sequence
  Synthetic oligonucleotide
agcatccaaactgctaaaga

SEQ ID NO: 2317 - DNA, 20 bp, Artificial sequence
  Synthetic oligonucleotide
tttcccccgagaactggaat

SEQ ID NO: 2318 - DNA, 20 bp, Artificial sequence
  Synthetic oligonucleotide
ctggcatataagatacacac

SEQ ID NO: 2319 - DNA, 20 bp, Artificial sequence
  Synthetic oligonucleotide
gcaggagtaaaaacaaaaat

SEQ ID NO: 2320 - DNA, 20 bp, Artificial sequence
  Synthetic oligonucleotide
gttccaaaagatagagacag

SEQ ID NO: 2321 - DNA, 20 bp, Artificial sequence
  Synthetic oligonucleotide
gtcaggaaacaaaaaaagtc

SEQ ID NO: 2322 - DNA, 20 bp, Artificial sequence
  Synthetic oligonucleotide
catatatacaaacctcctag

SEQ ID NO: 2323 - DNA, 20 bp, Artificial sequence
  Synthetic oligonucleotide
aaagatctaaacaagctcaa

SEQ ID NO: 2324 - DNA, 20 bp, Artificial sequence
  Synthetic oligonucleotide
cacaaaatacaatacaaaag

SEQ ID NO: 2325 - DNA, 20 bp, Artificial sequence
  Synthetic oligonucleotide
aagatcatactgttgcattc

SEQ ID NO: 2326 - DNA, 20 bp, Artificial sequence
  Synthetic oligonucleotide
aggcggatcaccataagtca

SEQ ID NO: 2327 - DNA, 20 bp, Artificial sequence
  Synthetic oligonucleotide
tcatttccttagttccatat

SEQ ID NO: 2328 - DNA, 20 bp, Artificial sequence
  Synthetic oligonucleotide
tctgccttgttttttctttc

SEQ ID NO: 2329 - DNA, 20 bp, Artificial sequence
  Synthetic oligonucleotide
tatatagttatatatttacg

SEQ ID NO: 2330 - DNA, 20 bp, Artificial sequence
  Synthetic oligonucleotide
tttatattatattaactcta

SEQ ID NO: 2331 - DNA, 20 bp, Artificial sequence
  Synthetic oligonucleotide
ggcttgtctctatcccctgt

SEQ ID NO: 2332 - DNA, 20 bp, Artificial sequence
  Synthetic oligonucleotide
gccccagcttccgggttcaa

SEQ ID NO: 2333 - DNA, 20 bp, Artificial sequence
  Synthetic oligonucleotide
gaaatattatttatactatt

SEQ ID NO: 2334 - DNA, 20 bp, Artificial sequence
  Synthetic oligonucleotide
tctcacaatcacagaaaaca

SEQ ID NO: 2335 - DNA, 20 bp, Artificial sequence
  Synthetic oligonucleotide
gactgcatttgtatttcatc

SEQ ID NO: 2336 - DNA, 20 bp, Artificial sequence
  Synthetic oligonucleotide
agattaacaaaatattaatt

SEQ ID NO: 2337 - DNA, 20 bp, Artificial sequence
  Synthetic oligonucleotide
tatcattcttaacagaaaaa

SEQ ID NO: 2338 - DNA, 20 bp, Artificial sequence
  Synthetic oligonucleotide
ctaagccattttataacagg

SEQ ID NO: 2339 - DNA, 20 bp, Artificial sequence
  Synthetic oligonucleotide
gcctaacaggctatggacca

SEQ ID NO: 2340 - DNA, 20 bp, Artificial sequence
  Synthetic oligonucleotide
cacggacagggatggtgagg

SEQ ID NO: 2341 - DNA, 20 bp, Artificial sequence
  Synthetic oligonucleotide
gtattgggcattatcagtaa

SEQ ID NO: 2342 - DNA, 20 bp, Artificial sequence
  Synthetic oligonucleotide
acttatcaacacttaaactg

SEQ ID NO: 2343 - DNA, 20 bp, Artificial sequence
  Synthetic oligonucleotide
taggtaattctaattttaat

SEQ ID NO: 2344 - DNA, 20 bp, Artificial sequence
  Synthetic oligonucleotide
tacctaggtggtttccatat

SEQ ID NO: 2345 - DNA, 20 bp, Artificial sequence
  Synthetic oligonucleotide
aatgacagggtcttctcctt

SEQ ID NO: 2346 - DNA, 20 bp, Artificial sequence
  Synthetic oligonucleotide
aaatgacagggtcttctcct

SEQ ID NO: 2347 - DNA, 20 bp, Artificial sequence
  Synthetic oligonucleotide
caaatgacagggtcttctcc

SEQ ID NO: 2348 - DNA, 20 bp, Artificial sequence
  Synthetic oligonucleotide
gcaaatgacagggtcttctc

SEQ ID NO: 2349 - DNA, 20 bp, Artificial sequence
  Synthetic oligonucleotide
ggcaaatgacagggtcttct

SEQ ID NO: 2350 - DNA, 20 bp, Artificial sequence
  Synthetic oligonucleotide
tggcaaatgacagggtcttc

SEQ ID NO: 2351 - DNA, 20 bp, Artificial sequence
  Synthetic oligonucleotide
gtggcaaatgacagggtctt

SEQ ID NO: 2352 - DNA, 20 bp, Artificial sequence
  Synthetic oligonucleotide
tgtggcaaatgacagggtct

SEQ ID NO: 2353 - DNA, 20 bp, Artificial sequence
  Synthetic oligonucleotide
ttgtggcaaatgacagggtc

SEQ ID NO: 2354 - DNA, 20 bp, Artificial sequence
  Synthetic oligonucleotide
actttttctttttagattcc

SEQ ID NO: 2355 - DNA, 20 bp, Artificial sequence
  Synthetic oligonucleotide
ttctcaactgcctgagtagc

SEQ ID NO: 2356 - DNA, 20 bp, Artificial sequence
  Synthetic oligonucleotide
tgtgtggactgtgttttttg

SEQ ID NO: 2357 - DNA, 20 bp, Artificial sequence
  Synthetic oligonucleotide
cagctttttagttcctccta

SEQ ID NO: 2358 - DNA, 20 bp, Artificial sequence
  Synthetic oligonucleotide
ttcccctgtggcaagagcag

SEQ ID NO: 2359 - DNA, 20 bp, Artificial sequence
  Synthetic oligonucleotide
atgctgttataagatgaatg

SEQ ID NO: 2360 - DNA, 20 bp, Artificial sequence
  Synthetic oligonucleotide
aaattattataattcactct

SEQ ID NO: 2361 - DNA, 20 bp, Artificial sequence
  Synthetic oligonucleotide
actttctgtgtggtatgttc

SEQ ID NO: 2362 - DNA, 20 bp, Artificial sequence
  Synthetic oligonucleotide
gactttctgtgtggtatgtt

SEQ ID NO: 2363 - DNA, 20 bp, Artificial sequence
  Synthetic oligonucleotide
agactttctgtgtggtatgt

SEQ ID NO: 2364 - DNA, 20 bp, Artificial sequence
  Synthetic oligonucleotide
cagactttctgtgtggtatg

SEQ ID NO: 2365 - DNA, 20 bp, Artificial sequence
  Synthetic oligonucleotide
acagactttctgtgtggtat

SEQ ID NO: 2366 - DNA, 20 bp, Artificial sequence
  Synthetic oligonucleotide
gacagactttctgtgtggta

SEQ ID NO: 2367 - DNA, 20 bp, Artificial sequence
  Synthetic oligonucleotide
agacagactttctgtgtggt

SEQ ID NO: 2368 - DNA, 20 bp, Artificial sequence
  Synthetic oligonucleotide
cagacagactttctgtgtgg

SEQ ID NO: 2369 - DNA, 20 bp, Artificial sequence
  Synthetic oligonucleotide
tcagacagactttctgtgtg

SEQ ID NO: 2370 - DNA, 20 bp, Artificial sequence
  Synthetic oligonucleotide
ttcagacagactttctgtgt

SEQ ID NO: 2371 - DNA, 20 bp, Artificial sequence
  Synthetic oligonucleotide
cttcagacagactttctgtg

SEQ ID NO: 2372 - DNA, 20 bp, Artificial sequence
  Synthetic oligonucleotide
ttgtattggtggagaaaaca

SEQ ID NO: 2373 - DNA, 20 bp, Artificial sequence
  Synthetic oligonucleotide
gtgttgagaatttttcattg

SEQ ID NO: 2374 - DNA, 20 bp, Artificial sequence
  Synthetic oligonucleotide
tagcatctctaatgtagtct

SEQ ID NO: 2375 - DNA, 20 bp, Artificial sequence
  Synthetic oligonucleotide
gtagctgaatttcttcagca

SEQ ID NO: 2376 - DNA, 20 bp, Artificial sequence
  Synthetic oligonucleotide
attacagtgaaatgaaacat

SEQ ID NO: 2377 - DNA, 20 bp, Artificial sequence
  Synthetic oligonucleotide
aaatacattttgcctctgtc

SEQ ID NO: 2378 - DNA, 20 bp, Artificial sequence
  Synthetic oligonucleotide
ctttaagactttccttagac

SEQ ID NO: 2379 - DNA, 20 bp, Artificial sequence
  Synthetic oligonucleotide
tttgttttaaaactagactt

SEQ ID NO: 2380 - DNA, 20 bp, Artificial sequence
  Synthetic oligonucleotide
aaaaagagatgaaaagtgtg

SEQ ID NO: 2381 - DNA, 20 bp, Artificial sequence
  Synthetic oligonucleotide
agatatggaggagagtgaaa

SEQ ID NO: 2382 - DNA, 20 bp, Artificial sequence
  Synthetic oligonucleotide
cttccctcagcaacaggcgc

SEQ ID NO: 2383 - DNA, 20 bp, Artificial sequence
  Synthetic oligonucleotide
ggtctagaatcattctgaag

SEQ ID NO: 2384 - DNA, 20 bp, Artificial sequence
  Synthetic oligonucleotide
aaggacctttcttctgaaag

SEQ ID NO: 2385 - DNA, 20 bp, Artificial sequence
  Synthetic oligonucleotide
tacacagagcacttcttatt

SEQ ID NO: 2386 - DNA, 20 bp, Artificial sequence
  Synthetic oligonucleotide
ctccctttttcccacatcta

SEQ ID NO: 2387 - DNA, 20 bp, Artificial sequence
  Synthetic oligonucleotide
aaattaagtgttaagcacac

SEQ ID NO: 2388 - DNA, 20 bp, Artificial sequence
  Synthetic oligonucleotide
aaatatttgctcagagacac

SEQ ID NO: 2389 - DNA, 20 bp, Artificial sequence
  Synthetic oligonucleotide
gaataaaaatgtataactat

SEQ ID NO: 2390 - DNA, 20 bp, Artificial sequence
  Synthetic oligonucleotide
cagagcctggccaaaatggc

SEQ ID NO: 2391 - DNA, 20 bp, Artificial sequence
  Synthetic oligonucleotide
agcacttaaacagaaaaaat

SEQ ID NO: 2392 - DNA, 20 bp, Artificial sequence
  Synthetic oligonucleotide
tctattgtatattaggttga

SEQ ID NO: 2393 - DNA, 20 bp, Artificial sequence
  Synthetic oligonucleotide
gatgaaggaagaatgatttt

SEQ ID NO: 2394 - DNA, 20 bp, Artificial sequence
  Synthetic oligonucleotide
gctagttcattgtatgtgtc

SEQ ID NO: 2395 - DNA, 20 bp, Artificial sequence
  Synthetic oligonucleotide
attgaataaaaatttgtatt

SEQ ID NO: 2396 - DNA, 20 bp, Artificial sequence
  Synthetic oligonucleotide
ccaggtataaaatttttttt

SEQ ID NO: 2397 - DNA, 20 bp, Artificial sequence
  Synthetic oligonucleotide
gatctaagaatacccctagt

SEQ ID NO: 2398 - DNA, 20 bp, Artificial sequence
  Synthetic oligonucleotide
ttagataaaaagtatactgt

SEQ ID NO: 2399 - DNA, 20 bp, Artificial sequence
  Synthetic oligonucleotide
gacagttttctaattttaca

SEQ ID NO: 2400 - DNA, 20 bp, Artificial sequence
  Synthetic oligonucleotide
gggttggaaataatacagag

SEQ ID NO: 2401 - DNA, 20 bp, Artificial sequence
  Synthetic oligonucleotide
ttgacctgcagtatcttgaa

SEQ ID NO: 2402 - DNA, 20 bp, Artificial sequence
  Synthetic oligonucleotide
tacatattcttattcaactc

SEQ ID NO: 2403 - DNA, 20 bp, Artificial sequence
  Synthetic oligonucleotide
atattattgattgttctaaa

SEQ ID NO: 2404 - DNA, 20 bp, Artificial sequence
  Synthetic oligonucleotide
ggatattcgattcaagaaca

SEQ ID NO: 2405 - DNA, 20 bp, Artificial sequence
  Synthetic oligonucleotide
ataaatttggaagctaatgt

SEQ ID NO: 2406 - DNA, 20 bp, Artificial sequence
  Synthetic oligonucleotide
accacattttgaaaataaag

SEQ ID NO: 2407 - DNA, 20 bp, Artificial sequence
  Synthetic oligonucleotide
agcacaggaaattaacatat

SEQ ID NO: 2408 - DNA, 20 bp, Artificial sequence
  Synthetic oligonucleotide
gtaggtgtgtttatttctat

SEQ ID NO: 2409 - DNA, 20 bp, Artificial sequence
  Synthetic oligonucleotide
cttttcatcagagatttttt

SEQ ID NO: 2410 - DNA, 20 bp, Artificial sequence
  Synthetic oligonucleotide
gaaatctaaaaacagcaaag

SEQ ID NO: 2411 - DNA, 20 bp, Artificial sequence
  Synthetic oligonucleotide
gactattgttttaatgtgtt

SEQ ID NO: 2412 - DNA, 20 bp, Artificial sequence
  Synthetic oligonucleotide
gggagatttgagagagaggc

SEQ ID NO: 2413 - DNA, 20 bp, Artificial sequence
  Synthetic oligonucleotide
atagtgggcttatggtgtac

SEQ ID NO: 2414 - DNA, 20 bp, Artificial sequence
  Synthetic oligonucleotide
atttctccatttctgtcact

SEQ ID NO: 2415 - DNA, 20 bp, Artificial sequence
  Synthetic oligonucleotide
caggagtaaggacacagacg

SEQ ID NO: 2416 - DNA, 20 bp, Artificial sequence
  Synthetic oligonucleotide
cctccagaaaaggtttttag

SEQ ID NO: 2417 - DNA, 20 bp, Artificial sequence
  Synthetic oligonucleotide
gaattgaaactgcttagaag

SEQ ID NO: 2418 - DNA, 20 bp, Artificial sequence
  Synthetic oligonucleotide
cctgactttgaattattttg

SEQ ID NO: 2419 - DNA, 20 bp, Artificial sequence
  Synthetic oligonucleotide
aaaatcagatagcagtggtg

SEQ ID NO: 2420 - DNA, 20 bp, Artificial sequence
  Synthetic oligonucleotide
agggtacagaaggaaagaca

SEQ ID NO: 2421 - DNA, 20 bp, Artificial sequence
  Synthetic oligonucleotide
tgagaggtgtttgttttgaa

SEQ ID NO: 2422 - DNA, 20 bp, Artificial sequence
  Synthetic oligonucleotide
tgttggcaagcttgaaggga

SEQ ID NO: 2423 - DNA, 20 bp, Artificial sequence
  Synthetic oligonucleotide
aattgaagggttgtaacagg

SEQ ID NO: 2424 - DNA, 20 bp, Artificial sequence
  Synthetic oligonucleotide
gctggaaaattagtctgtag

SEQ ID NO: 2425 - DNA, 20 bp, Artificial sequence
  Synthetic oligonucleotide
catggcatggtctatacatt

SEQ ID NO: 2426 - DNA, 20 bp, Artificial sequence
  Synthetic oligonucleotide
aggtctcatggctggcaagt

SEQ ID NO: 2427 - DNA, 20 bp, Artificial sequence
  Synthetic oligonucleotide
aaacactttatcaaatctta

SEQ ID NO: 2428 - DNA, 20 bp, Artificial sequence
  Synthetic oligonucleotide
atcagaacaagttaaacatt

SEQ ID NO: 2429 - DNA, 20 bp, Artificial sequence
  Synthetic oligonucleotide
tcttttattcttgtatcact

SEQ ID NO: 2430 - DNA, 20 bp, Artificial sequence
  Synthetic oligonucleotide
tagccttttgatctgttttt

SEQ ID NO: 2431 - DNA, 20 bp, Artificial sequence
  Synthetic oligonucleotide
taagaattatgttaaaacca

SEQ ID NO: 2432 - DNA, 20 bp, Artificial sequence
  Synthetic oligonucleotide
cttaaattttaacaattaaa

SEQ ID NO: 2433 - DNA, 20 bp, Artificial sequence
  Synthetic oligonucleotide
aatttaccccctagtaggct

SEQ ID NO: 2434 - DNA, 20 bp, Artificial sequence
  Synthetic oligonucleotide
agtaacattttgaaatgatg

SEQ ID NO: 2435 - DNA, 20 bp, Artificial sequence
  Synthetic oligonucleotide
cctgtagttcagttttactg

SEQ ID NO: 2436 - DNA, 20 bp, Artificial sequence
  Synthetic oligonucleotide
agatatgaaaattttcactt

SEQ ID NO: 2437 - DNA, 20 bp, Artificial sequence
  Synthetic oligonucleotide
cttttaactttagctaaata

SEQ ID NO: 2438 - DNA, 20 bp, Artificial sequence
  Synthetic oligonucleotide
aggaccaaagctatggttag

SEQ ID NO: 2439 - DNA, 20 bp, Artificial sequence
  Synthetic oligonucleotide
caaacaaataacagctttca

SEQ ID NO: 2440 - DNA, 20 bp, Artificial sequence
  Synthetic oligonucleotide
ataacaaaattcagtgcaac

SEQ ID NO: 2441 - DNA, 20 bp, Artificial sequence
  Synthetic oligonucleotide
acatttaaagttttaacact

SEQ ID NO: 2442 - DNA, 20 bp, Artificial sequence
  Synthetic oligonucleotide
gttttatagttgacagatga

SEQ ID NO: 2443 - DNA, 20 bp, Artificial sequence
  Synthetic oligonucleotide
tctctaaatttgttgattta

SEQ ID NO: 2444 - DNA, 20 bp, Artificial sequence
  Synthetic oligonucleotide
tgcaggcactcacaaacatt

SEQ ID NO: 2445 - DNA, 20 bp, Artificial sequence
  Synthetic oligonucleotide
acaccttttctcttcttttt

SEQ ID NO: 2446 - DNA, 20 bp, Artificial sequence
  Synthetic oligonucleotide
atctactgtttgaaagggtg

SEQ ID NO: 2447 - DNA, 20 bp, Artificial sequence
  Synthetic oligonucleotide
acattgctcagagttcatgt

SEQ ID NO: 2448 - DNA, 20 bp, Artificial sequence
  Synthetic oligonucleotide
taggtaccatcagaatttca

SEQ ID NO: 2449 - DNA, 20 bp, Artificial sequence
  Synthetic oligonucleotide
tcattctctgctacaataaa

SEQ ID NO: 2450 - DNA, 20 bp, Artificial sequence
  Synthetic oligonucleotide
gaaattttccagctaaaaaa

SEQ ID NO: 2451 - DNA, 20 bp, Artificial sequence
  Synthetic oligonucleotide
tgaaattttccagctaaaaa

SEQ ID NO: 2452 - DNA, 20 bp, Artificial sequence
  Synthetic oligonucleotide
ttgaaattttccagctaaaa

SEQ ID NO: 2453 - DNA, 20 bp, Artificial sequence
  Synthetic oligonucleotide
cttgaaattttccagctaaa

SEQ ID NO: 2454 - DNA, 20 bp, Artificial sequence
  Synthetic oligonucleotide
tcttgaaattttccagctaa

SEQ ID NO: 2455 - DNA, 20 bp, Artificial sequence
  Synthetic oligonucleotide
atcttgaaattttccagcta

SEQ ID NO: 2456 - DNA, 20 bp, Artificial sequence
  Synthetic oligonucleotide
aatcttgaaattttccagct

SEQ ID NO: 2457 - DNA, 20 bp, Artificial sequence
  Synthetic oligonucleotide
aaatcttgaaattttccagc

SEQ ID NO: 2458 - DNA, 20 bp, Artificial sequence
  Synthetic oligonucleotide
taaatcttgaaattttccag

SEQ ID NO: 2459 - DNA, 20 bp, Artificial sequence
  Synthetic oligonucleotide
ataaatcttgaaattttcca

SEQ ID NO: 2460 - DNA, 20 bp, Artificial sequence
  Synthetic oligonucleotide
cataaatcttgaaattttcc

SEQ ID NO: 2461 - DNA, 20 bp, Artificial sequence
  Synthetic oligonucleotide
atttctttctcaagcccaaa

SEQ ID NO: 2462 - DNA, 20 bp, Artificial sequence
  Synthetic oligonucleotide
tacattcctactgtatttac

SEQ ID NO: 2463 - DNA, 20 bp, Artificial sequence
  Synthetic oligonucleotide
tgctttgatatggcttggag

SEQ ID NO: 2464 - DNA, 20 bp, Artificial sequence
  Synthetic oligonucleotide
tggtatgagtcacataagta

SEQ ID NO: 2465 - DNA, 20 bp, Artificial sequence
  Synthetic oligonucleotide
cctagaaattttgccttttc

SEQ ID NO: 2466 - DNA, 20 bp, Artificial sequence
  Synthetic oligonucleotide
ctgcaggttctggagagctg

SEQ ID NO: 2467 - DNA, 20 bp, Artificial sequence
  Synthetic oligonucleotide
tgtttactgccactattcac

SEQ ID NO: 2468 - DNA, 20 bp, Artificial sequence
  Synthetic oligonucleotide
ctaactgaacttttaaaaat

SEQ ID NO: 2469 - DNA, 20 bp, Artificial sequence
  Synthetic oligonucleotide
aatacaatctatcagcatta

SEQ ID NO: 2470 - DNA, 20 bp, Artificial sequence
  Synthetic oligonucleotide
aattttggaggaatttattt

SEQ ID NO: 2471 - DNA, 20 bp, Artificial sequence
  Synthetic oligonucleotide
ttgtgcttcaataataccaa

SEQ ID NO: 2472 - DNA, 20 bp, Artificial sequence
  Synthetic oligonucleotide
tgggtttcatggtgttagct

SEQ ID NO: 2473 - DNA, 20 bp, Artificial sequence
  Synthetic oligonucleotide
gtaggctcagtgcaaactct

SEQ ID NO: 2474 - DNA, 20 bp, Artificial sequence
  Synthetic oligonucleotide
agtctttttacattataata

SEQ ID NO: 2475 - DNA, 20 bp, Artificial sequence
  Synthetic oligonucleotide
taacagatttgtggtgaaaa

SEQ ID NO: 2476 - DNA, 20 bp, Artificial sequence
  Synthetic oligonucleotide
aaccataagagaggacaaac

SEQ ID NO: 2477 - DNA, 20 bp, Artificial sequence
  Synthetic oligonucleotide
aatgatctttaaaacattca

SEQ ID NO: 2478 - DNA, 20 bp, Artificial sequence
  Synthetic oligonucleotide
gaggacaataaaatgacctt

SEQ ID NO: 2479 - DNA, 20 bp, Artificial sequence
  Synthetic oligonucleotide
ctcctctcaactgccagcgc

SEQ ID NO: 2480 - DNA, 20 bp, Artificial sequence
  Synthetic oligonucleotide
tttactaagtcatctgtgaa

SEQ ID NO: 2481 - DNA, 20 bp, Artificial sequence
  Synthetic oligonucleotide
cttatgagctgtttaggaag

SEQ ID NO: 2482 - DNA, 20 bp, Artificial sequence
  Synthetic oligonucleotide
tgtcaactctgccaatgtga

SEQ ID NO: 2483 - DNA, 20 bp, Artificial sequence
  Synthetic oligonucleotide
aataaatgctatgtaattta

SEQ ID NO: 2484 - DNA, 20 bp, Artificial sequence
  Synthetic oligonucleotide
gaagggttgctatgatagtt

SEQ ID NO: 2485 - DNA, 20 bp, Artificial sequence
  Synthetic oligonucleotide
tgaattctaaccaaaagctt

SEQ ID NO: 2486 - DNA, 20 bp, Artificial sequence
  Synthetic oligonucleotide
gacaaatgtgtcacttttta

SEQ ID NO: 2487 - DNA, 20 bp, Artificial sequence
  Synthetic oligonucleotide
aaattcatgaggaatgcaat

SEQ ID NO: 2488 - DNA, 20 bp, Artificial sequence
  Synthetic oligonucleotide
catacaatatttttgacaga

SEQ ID NO: 2489 - DNA, 20 bp, Artificial sequence
  Synthetic oligonucleotide
gtgacgcacatttacaccag

SEQ ID NO: 2490 - DNA, 20 bp, Artificial sequence
  Synthetic oligonucleotide
aaagatttttatcttagcct

SEQ ID NO: 2491 - DNA, 20 bp, Artificial sequence
  Synthetic oligonucleotide
ccatttacaaagatgaccag

SEQ ID NO: 2492 - DNA, 20 bp, Artificial sequence
  Synthetic oligonucleotide
tcaaagtagtgaattacatc

SEQ ID NO: 2493 - DNA, 20 bp, Artificial sequence
  Synthetic oligonucleotide
tgtttggacttataaactat

SEQ ID NO: 2494 - DNA, 20 bp, Artificial sequence
  Synthetic oligonucleotide
taatgggcaagcaaaaaatt

SEQ ID NO: 2495 - DNA, 20 bp, Artificial sequence
  Synthetic oligonucleotide
tcatgttgcctaggctagaa

SEQ ID NO: 2496 - DNA, 20 bp, Artificial sequence
  Synthetic oligonucleotide
ctagataacatacaatataa

SEQ ID NO: 2497 - DNA, 20 bp, Artificial sequence
  Synthetic oligonucleotide
gagaaattattatattttat

SEQ ID NO: 2498 - DNA, 20 bp, Artificial sequence
  Synthetic oligonucleotide
agactacaaaattgctaaaa

SEQ ID NO: 2499 - DNA, 20 bp, Artificial sequence
  Synthetic oligonucleotide
caaaaagatttttatggagt

SEQ ID NO: 2500 - DNA, 20 bp, Artificial sequence
  Synthetic oligonucleotide
aatttaagtttaaatattct

SEQ ID NO: 2501 - DNA, 20 bp, Artificial sequence
  Synthetic oligonucleotide
cctcattttgccagtattaa

SEQ ID NO: 2502 - DNA, 20 bp, Artificial sequence
  Synthetic oligonucleotide
atgggaaaattgtgactgtt

SEQ ID NO: 2503 - DNA, 20 bp, Artificial sequence
  Synthetic oligonucleotide
gcaaatatatgaatttttta

SEQ ID NO: 2504 - DNA, 20 bp, Artificial sequence
  Synthetic oligonucleotide
tcattggaaaatcttgaacg

SEQ ID NO: 2505 - DNA, 20 bp, Artificial sequence
  Synthetic oligonucleotide
atttgtagacctatgttgaa

SEQ ID NO: 2506 - DNA, 20 bp, Artificial sequence
  Synthetic oligonucleotide
gaataataagattcagtcat

SEQ ID NO: 2507 - DNA, 20 bp, Artificial sequence
  Synthetic oligonucleotide
gaaaccattaaaatatttat

SEQ ID NO: 2508 - DNA, 20 bp, Artificial sequence
  Synthetic oligonucleotide
tctaagtttttattaattaa

SEQ ID NO: 2509 - DNA, 20 bp, Artificial sequence
  Synthetic oligonucleotide
atgattaggatttttatttc

SEQ ID NO: 2510 - DNA, 20 bp, Artificial sequence
  Synthetic oligonucleotide
tttatatttaaatcacacaa

SEQ ID NO: 2511 - DNA, 20 bp, Artificial sequence
  Synthetic oligonucleotide
aattgctgttttaatcatga

SEQ ID NO: 2512 - DNA, 20 bp, Artificial sequence
  Synthetic oligonucleotide
cagatttatctacttgaaac

SEQ ID NO: 2513 - DNA, 20 bp, Artificial sequence
  Synthetic oligonucleotide
gtagagtttttggtcagtgg

SEQ ID NO: 2514 - DNA, 20 bp, Artificial sequence
  Synthetic oligonucleotide
tttttgttcttgggatgttg

SEQ ID NO: 2515 - DNA, 20 bp, Artificial sequence
  Synthetic oligonucleotide
taactttcaaccgtgaaaaa

SEQ ID NO: 2516 - DNA, 20 bp, Artificial sequence
  Synthetic oligonucleotide
gtctgttttctaactagctt

SEQ ID NO: 2517 - DNA, 20 bp, Artificial sequence
  Synthetic oligonucleotide
gcacattgtcaaataaacaa

SEQ ID NO: 2518 - DNA, 20 bp, Artificial sequence
  Synthetic oligonucleotide
caggaattatccaaagtcac

SEQ ID NO: 2519 - DNA, 20 bp, Artificial sequence
  Synthetic oligonucleotide
acctgggttaagtaaatggc

SEQ ID NO: 2520 - DNA, 20 bp, Artificial sequence
  Synthetic oligonucleotide
cactggagagactgtgaagg

SEQ ID NO: 2521 - DNA, 20 bp, Artificial sequence
  Synthetic oligonucleotide
agcagcagatttcaaaaggg

SEQ ID NO: 2522 - DNA, 20 bp, Artificial sequence
  Synthetic oligonucleotide
ttttgattgtggtaattgga

SEQ ID NO: 2523 - DNA, 20 bp, Artificial sequence
  Synthetic oligonucleotide
tacaagagtggaaatggctg

SEQ ID NO: 2524 - DNA, 20 bp, Artificial sequence
  Synthetic oligonucleotide
ccgttacatgctctctaatt

SEQ ID NO: 2525 - DNA, 20 bp, Artificial sequence
  Synthetic oligonucleotide
ctcctgatctcaattgaaat

SEQ ID NO: 2526 - DNA, 20 bp, Artificial sequence
  Synthetic oligonucleotide
aagccttcatatacgagttt

SEQ ID NO: 2527 - DNA, 20 bp, Artificial sequence
  Synthetic oligonucleotide
tatctccagccttcacctct

SEQ ID NO: 2528 - DNA, 20 bp, Artificial sequence
  Synthetic oligonucleotide
tctccttcttacaaaatcca

SEQ ID NO: 2529 - DNA, 20 bp, Artificial sequence
  Synthetic oligonucleotide
gttgttcttcttcttattat

SEQ ID NO: 2530 - DNA, 20 bp, Artificial sequence
  Synthetic oligonucleotide
gttaaaatttgaaataatga

SEQ ID NO: 2531 - DNA, 20 bp, Artificial sequence
  Synthetic oligonucleotide
agttgtgaccatgcaataaa

SEQ ID NO: 2532 - DNA, 20 bp, Artificial sequence
  Synthetic oligonucleotide
aagttgtgaccatgcaataa

SEQ ID NO: 2533 - DNA, 20 bp, Artificial sequence
  Synthetic oligonucleotide
taagttgtgaccatgcaata

SEQ ID NO: 2534 - DNA, 20 bp, Artificial sequence
  Synthetic oligonucleotide
gtaagttgtgaccatgcaat

SEQ ID NO: 2535 - DNA, 20 bp, Artificial sequence
  Synthetic oligonucleotide
agtaagttgtgaccatgcaa

SEQ ID NO: 2536 - DNA, 20 bp, Artificial sequence
  Synthetic oligonucleotide
tagtaagttgtgaccatgca

SEQ ID NO: 2537 - DNA, 20 bp, Artificial sequence
  Synthetic oligonucleotide
ttagtaagttgtgaccatgc

SEQ ID NO: 2538 - DNA, 20 bp, Artificial sequence
  Synthetic oligonucleotide
attagtaagttgtgaccatg

SEQ ID NO: 2539 - DNA, 20 bp, Artificial sequence
  Synthetic oligonucleotide
cattagtaagttgtgaccat

SEQ ID NO: 2540 - DNA, 20 bp, Artificial sequence
  Synthetic oligonucleotide
ccattagtaagttgtgacca

SEQ ID NO: 2541 - DNA, 20 bp, Artificial sequence
  Synthetic oligonucleotide
cccattagtaagttgtgacc

SEQ ID NO: 2542 - DNA, 20 bp, Artificial sequence
  Synthetic oligonucleotide
gctatcaagacattatgtag

SEQ ID NO: 2543 - DNA, 20 bp, Artificial sequence
  Synthetic oligonucleotide
atctatgaaagcaaatgttt

SEQ ID NO: 2544 - DNA, 20 bp, Artificial sequence
  Synthetic oligonucleotide
cttttttaaacaaaatacag

SEQ ID NO: 2545 - DNA, 20 bp, Artificial sequence
  Synthetic oligonucleotide
atgctacaagcaggcactta

SEQ ID NO: 2546 - DNA, 20 bp, Artificial sequence
  Synthetic oligonucleotide
tctgttatcttaagaggctt

SEQ ID NO: 2547 - DNA, 20 bp, Artificial sequence
  Synthetic oligonucleotide
tggactttattgctcaaagc

SEQ ID NO: 2548 - DNA, 20 bp, Artificial sequence
  Synthetic oligonucleotide
cagacaaaaacatccgatat

SEQ ID NO: 2549 - DNA, 20 bp, Artificial sequence
  Synthetic oligonucleotide
ccctagacaactatcacctg

SEQ ID NO: 2550 - DNA, 20 bp, Artificial sequence
  Synthetic oligonucleotide
tggaagccctgaggaagtgg

SEQ ID NO: 2551 - DNA, 20 bp, Artificial sequence
  Synthetic oligonucleotide
aacagcaaggacaatgtcta

SEQ ID NO: 2552 - DNA, 20 bp, Artificial sequence
  Synthetic oligonucleotide
gccatgtgttatatactttg

SEQ ID NO: 2553 - DNA, 20 bp, Artificial sequence
  Synthetic oligonucleotide
attaggtagattttttttaa

SEQ ID NO: 2554 - DNA, 20 bp, Artificial sequence
  Synthetic oligonucleotide
atgatggtgaataaattaaa

SEQ ID NO: 2555 - DNA, 20 bp, Artificial sequence
  Synthetic oligonucleotide
agaaaatgctttaagctcat

SEQ ID NO: 2556 - DNA, 20 bp, Artificial sequence
  Synthetic oligonucleotide
aaaagataaattgctaggtt

SEQ ID NO: 2557 - DNA, 20 bp, Artificial sequence
  Synthetic oligonucleotide
actaattaattagttgaata

SEQ ID NO: 2558 - DNA, 20 bp, Artificial sequence
  Synthetic oligonucleotide
tcaattctctttagaatttc

SEQ ID NO: 2559 - DNA, 20 bp, Artificial sequence
  Synthetic oligonucleotide
agagattcatgctcatttat

SEQ ID NO: 2560 - DNA, 20 bp, Artificial sequence
  Synthetic oligonucleotide
atctatccactctcctatag

SEQ ID NO: 2561 - DNA, 20 bp, Artificial sequence
  Synthetic oligonucleotide
acttttttattagagccccc

SEQ ID NO: 2562 - DNA, 20 bp, Artificial sequence
  Synthetic oligonucleotide
gactacatgtcctttaaatg

SEQ ID NO: 2563 - DNA, 20 bp, Artificial sequence
  Synthetic oligonucleotide
aagactgcaggcttgagcca

SEQ ID NO: 2564 - DNA, 20 bp, Artificial sequence
  Synthetic oligonucleotide
atgccaccacatcccacttt

SEQ ID NO: 2565 - DNA, 20 bp, Artificial sequence
  Synthetic oligonucleotide
tgttatattttaaaagtttc

SEQ ID NO: 2566 - DNA, 20 bp, Artificial sequence
  Synthetic oligonucleotide
atatacacaaaagcagatat

SEQ ID NO: 2567 - DNA, 20 bp, Artificial sequence
  Synthetic oligonucleotide
aaatatatgtgtaaatacac

SEQ ID NO: 2568 - DNA, 20 bp, Artificial sequence
  Synthetic oligonucleotide
ctcccattctctctctctac

SEQ ID NO: 2569 - DNA, 20 bp, Artificial sequence
  Synthetic oligonucleotide
cccagaaactaacatcttct

SEQ ID NO: 2570 - DNA, 20 bp, Artificial sequence
  Synthetic oligonucleotide
caggaaaaagaatactttct

SEQ ID NO: 2571 - DNA, 20 bp, Artificial sequence
  Synthetic oligonucleotide
tcctgccaccacacccacta

SEQ ID NO: 2572 - DNA, 20 bp, Artificial sequence
  Synthetic oligonucleotide
tagctatagtgcaatggcgc

SEQ ID NO: 2573 - DNA, 20 bp, Artificial sequence
  Synthetic oligonucleotide
tttcataactgtatgatttg

SEQ ID NO: 2574 - DNA, 20 bp, Artificial sequence
  Synthetic oligonucleotide
accattaaaagtttagtgga

SEQ ID NO: 2575 - DNA, 20 bp, Artificial sequence
  Synthetic oligonucleotide
atgtgcatgccagtgtgtta

SEQ ID NO: 2576 - DNA, 20 bp, Artificial sequence
  Synthetic oligonucleotide
gataaagaaggaatgcacaa

SEQ ID NO: 2577 - DNA, 20 bp, Artificial sequence
  Synthetic oligonucleotide
cttactttcttgcaaaaggg

SEQ ID NO: 2578 - DNA, 20 bp, Artificial sequence
  Synthetic oligonucleotide
gaaaataaaaaggcagcttt

SEQ ID NO: 2579 - DNA, 20 bp, Artificial sequence
  Synthetic oligonucleotide
taatagtgaatgttgtttta

SEQ ID NO: 2580 - DNA, 20 bp, Artificial sequence
  Synthetic oligonucleotide
catgcatctaaagataactg

SEQ ID NO: 2581 - DNA, 20 bp, Artificial sequence
  Synthetic oligonucleotide
tcctaggctttgtctcttaa

SEQ ID NO: 2582 - DNA, 20 bp, Artificial sequence
  Synthetic oligonucleotide
tttaaaactttatcttcctt

SEQ ID NO: 2583 - DNA, 20 bp, Artificial sequence
  Synthetic oligonucleotide
agatactgttgccccaagta

SEQ ID NO: 2584 - DNA, 20 bp, Artificial sequence
  Synthetic oligonucleotide
tactaaaaaaaaccactaac

SEQ ID NO: 2585 - DNA, 20 bp, Artificial sequence
  Synthetic oligonucleotide
ccactgtctaacaaataatg

SEQ ID NO: 2586 - DNA, 20 bp, Artificial sequence
  Synthetic oligonucleotide
atgattggtgtaagcgaatg

SEQ ID NO: 2587 - DNA, 20 bp, Artificial sequence
  Synthetic oligonucleotide
attatccttcaacagagcta

SEQ ID NO: 2588 - DNA, 20 bp, Artificial sequence
  Synthetic oligonucleotide
gcccatccttagatcttagt

SEQ ID NO: 2589 - DNA, 20 bp, Artificial sequence
  Synthetic oligonucleotide
cgagtgactcagtttcctta

SEQ ID NO: 2590 - DNA, 20 bp, Artificial sequence
  Synthetic oligonucleotide
ccttcactttggaggatgcg

SEQ ID NO: 2591 - DNA, 20 bp, Artificial sequence
  Synthetic oligonucleotide
cctagagggtgccttcccag

SEQ ID NO: 2592 - DNA, 20 bp, Artificial sequence
  Synthetic oligonucleotide
atatttacactgcttcataa

SEQ ID NO: 2593 - DNA, 20 bp, Artificial sequence
  Synthetic oligonucleotide
ttatgacctgtaatgtactt

SEQ ID NO: 2594 - DNA, 20 bp, Artificial sequence
  Synthetic oligonucleotide
caaaagacaagcacacacac

SEQ ID NO: 2595 - DNA, 20 bp, Artificial sequence
  Synthetic oligonucleotide
taagtatttttagtacttta

SEQ ID NO: 2596 - DNA, 20 bp, Artificial sequence
  Synthetic oligonucleotide
gagggacttttgcaattgtc

SEQ ID NO: 2597 - DNA, 20 bp, Artificial sequence
  Synthetic oligonucleotide
gaatcaaaataagaggtcaa

SEQ ID NO: 2598 - DNA, 20 bp, Artificial sequence
  Synthetic oligonucleotide
ttttgagttccagggattca

SEQ ID NO: 2599 - DNA, 20 bp, Artificial sequence
  Synthetic oligonucleotide
gttttgagttccagggattc

SEQ ID NO: 2600 - DNA, 20 bp, Artificial sequence
  Synthetic oligonucleotide
tgttttgagttccagggatt

SEQ ID NO: 2601 - DNA, 20 bp, Artificial sequence
  Synthetic oligonucleotide
atgttttgagttccagggat

SEQ ID NO: 2602 - DNA, 20 bp, Artificial sequence
  Synthetic oligonucleotide
aatgttttgagttccaggga

SEQ ID NO: 2603 - DNA, 20 bp, Artificial sequence
  Synthetic oligonucleotide
caatgttttgagttccaggg

SEQ ID NO: 2604 - DNA, 20 bp, Artificial sequence
  Synthetic oligonucleotide
gcaatgttttgagttccagg

SEQ ID NO: 2605 - DNA, 20 bp, Artificial sequence
  Synthetic oligonucleotide
agcaatgttttgagttccag

SEQ ID NO: 2606 - DNA, 20 bp, Artificial sequence
  Synthetic oligonucleotide
cagcaatgttttgagttcca

SEQ ID NO: 2607 - DNA, 20 bp, Artificial sequence
  Synthetic oligonucleotide
tcagcaatgttttgagttcc

SEQ ID NO: 2608 - DNA, 20 bp, Artificial sequence
  Synthetic oligonucleotide
ttcagcaatgttttgagttc

SEQ ID NO: 2609 - DNA, 20 bp, Artificial sequence
  Synthetic oligonucleotide
gcatttcttaatttttttat

SEQ ID NO: 2610 - DNA, 20 bp, Artificial sequence
  Synthetic oligonucleotide
ttgtctgctactattttttc

SEQ ID NO: 2611 - DNA, 20 bp, Artificial sequence
  Synthetic oligonucleotide
tttaatatttatgaatgtga

SEQ ID NO: 2612 - DNA, 20 bp, Artificial sequence
  Synthetic oligonucleotide
aagcctttattttttattgc

SEQ ID NO: 2613 - DNA, 20 bp, Artificial sequence
  Synthetic oligonucleotide
atgagggcaagctggctttt

SEQ ID NO: 2614 - DNA, 20 bp, Artificial sequence
  Synthetic oligonucleotide
caaggagattgagtttacca

SEQ ID NO: 2615 - DNA, 20 bp, Artificial sequence
  Synthetic oligonucleotide
caaagcattcttgcttgctc

SEQ ID NO: 2616 - DNA, 20 bp, Artificial sequence
  Synthetic oligonucleotide
taatttatgtcagtcattaa

SEQ ID NO: 2617 - DNA, 20 bp, Artificial sequence
  Synthetic oligonucleotide
ggctgccgaaagcaggaaaa

SEQ ID NO: 2618 - DNA, 20 bp, Artificial sequence
  Synthetic oligonucleotide
tttaaatgtcacagctattt

SEQ ID NO: 2619 - DNA, 20 bp, Artificial sequence
  Synthetic oligonucleotide
cttcccctaaatctctctgt

SEQ ID NO: 2620 - DNA, 20 bp, Artificial sequence
  Synthetic oligonucleotide
agttaacaaattaatgaaac

SEQ ID NO: 2621 - DNA, 20 bp, Artificial sequence
  Synthetic oligonucleotide
aacttcagttttgtggcggg

SEQ ID NO: 2622 - DNA, 20 bp, Artificial sequence
  Synthetic oligonucleotide
cctggaaaatgaggactttc

SEQ ID NO: 2623 - DNA, 20 bp, Artificial sequence
  Synthetic oligonucleotide
actgattaagaaatgtgagg

SEQ ID NO: 2624 - DNA, 20 bp, Artificial sequence
  Synthetic oligonucleotide
tgaaagccaccgtgatgaac

SEQ ID NO: 2625 - DNA, 20 bp, Artificial sequence
  Synthetic oligonucleotide
agattaaagcgattcctgct

SEQ ID NO: 2626 - DNA, 20 bp, Artificial sequence
  Synthetic oligonucleotide
cttagtatcatcatcatcac

SEQ ID NO: 2627 - DNA, 20 bp, Artificial sequence
  Synthetic oligonucleotide
cccagaaaataagcagactg

SEQ ID NO: 2628 - DNA, 20 bp, Artificial sequence
  Synthetic oligonucleotide
gcaaatacaatatttgaaag

SEQ ID NO: 2629 - DNA, 20 bp, Artificial sequence
  Synthetic oligonucleotide
gatcagaatgaccagtgcac

SEQ ID NO: 2630 - DNA, 20 bp, Artificial sequence
  Synthetic oligonucleotide
tcaaactataatttggtgtc

SEQ ID NO: 2631 - DNA, 20 bp, Artificial sequence
  Synthetic oligonucleotide
tctagagaatgattcatctt

SEQ ID NO: 2632 - DNA, 20 bp, Artificial sequence
  Synthetic oligonucleotide
taccctcttgctatacaaac

SEQ ID NO: 2633 - DNA, 20 bp, Artificial sequence
  Synthetic oligonucleotide
gatgaaaattgaaatttgat

SEQ ID NO: 2634 - DNA, 20 bp, Artificial sequence
  Synthetic oligonucleotide
ttaaaaataactgtatttgg

SEQ ID NO: 2635 - DNA, 20 bp, Artificial sequence
  Synthetic oligonucleotide
attaactaaaaaccaagtct

SEQ ID NO: 2636 - DNA, 20 bp, Artificial sequence
  Synthetic oligonucleotide
caaagctgcagaccattttg

SEQ ID NO: 2637 - DNA, 20 bp, Artificial sequence
  Synthetic oligonucleotide
acaggcaaagaatttttgag

SEQ ID NO: 2638 - DNA, 20 bp, Artificial sequence
  Synthetic oligonucleotide
aaacaactgctgagaagcag

SEQ ID NO: 2639 - DNA, 20 bp, Artificial sequence
  Synthetic oligonucleotide
tttaattgctgttgtgtggt

SEQ ID NO: 2640 - DNA, 20 bp, Artificial sequence
  Synthetic oligonucleotide
taagacataaatgtcagagg

SEQ ID NO: 2641 - DNA, 20 bp, Artificial sequence
  Synthetic oligonucleotide
tgaagatgaagaaaggaaag

SEQ ID NO: 2642 - DNA, 20 bp, Artificial sequence
  Synthetic oligonucleotide
gagccaataacagagatgat

SEQ ID NO: 2643 - DNA, 20 bp, Artificial sequence
  Synthetic oligonucleotide
agactgttaatgtagtagga

SEQ ID NO: 2644 - DNA, 20 bp, Artificial sequence
  Synthetic oligonucleotide
ggacaattaattttgagggt

SEQ ID NO: 2645 - DNA, 20 bp, Artificial sequence
  Synthetic oligonucleotide
cttcaggagataaaggaacc

SEQ ID NO: 2646 - DNA, 20 bp, Artificial sequence
  Synthetic oligonucleotide
ttatgcttcagggatgcata

SEQ ID NO: 2647 - DNA, 20 bp, Artificial sequence
  Synthetic oligonucleotide
tttactaagtaattggtact

SEQ ID NO: 2648 - DNA, 20 bp, Artificial sequence
  Synthetic oligonucleotide
aaggcagcaaagaggtaaaa

SEQ ID NO: 2649 - DNA, 20 bp, Artificial sequence
  Synthetic oligonucleotide
ggtaagtcatcagagttcat

SEQ ID NO: 2650 - DNA, 20 bp, Artificial sequence
  Synthetic oligonucleotide
ttgagtctgagatgcctcca

SEQ ID NO: 2651 - DNA, 20 bp, Artificial sequence
  Synthetic oligonucleotide
tttgagcttgaccaactagg

SEQ ID NO: 2652 - DNA, 20 bp, Artificial sequence
  Synthetic oligonucleotide
gcagttactgacttgcttga

SEQ ID NO: 2653 - DNA, 20 bp, Artificial sequence
  Synthetic oligonucleotide
gctgcaagcacacctgcctt

SEQ ID NO: 2654 - DNA, 20 bp, Artificial sequence
  Synthetic oligonucleotide
aagaggaacgcagagctcag

SEQ ID NO: 2655 - DNA, 20 bp, Artificial sequence
  Synthetic oligonucleotide
gagtatcatgattttcttgc

SEQ ID NO: 2656 - DNA, 20 bp, Artificial sequence
  Synthetic oligonucleotide
caagcctgccagtcttttga

SEQ ID NO: 2657 - DNA, 20 bp, Artificial sequence
  Synthetic oligonucleotide
tataggtgcaaactacaagt

SEQ ID NO: 2658 - DNA, 20 bp, Artificial sequence
  Synthetic oligonucleotide
ggaatacagccaaaaacttg

SEQ ID NO: 2659 - DNA, 20 bp, Artificial sequence
  Synthetic oligonucleotide
agctacattcaagtctgcaa

SEQ ID NO: 2660 - DNA, 20 bp, Artificial sequence
  Synthetic oligonucleotide
cgaatgggcggatcacaagg

SEQ ID NO: 2661 - DNA, 20 bp, Artificial sequence
  Synthetic oligonucleotide
aagaatcgaaactaaaaacc

SEQ ID NO: 2662 - DNA, 20 bp, Artificial sequence
  Synthetic oligonucleotide
aatgtatatcatatattgtc

SEQ ID NO: 2663 - DNA, 20 bp, Artificial sequence
  Synthetic oligonucleotide
gacccatgcacagtcataat

SEQ ID NO: 2664 - DNA, 20 bp, Artificial sequence
  Synthetic oligonucleotide
cgtaaatgtttcaactgaaa

SEQ ID NO: 2665 - DNA, 20 bp, Artificial sequence
  Synthetic oligonucleotide
gttggaagctcaggagaaaa

SEQ ID NO: 2666 - DNA, 20 bp, Artificial sequence
  Synthetic oligonucleotide
ttgttgaggaactgaaattg

SEQ ID NO: 2667 - DNA, 20 bp, Artificial sequence
  Synthetic oligonucleotide
agtgggcttgtggtatttgt

SEQ ID NO: 2668 - DNA, 20 bp, Artificial sequence
  Synthetic oligonucleotide
gcaaagggagaacaaacaaa

SEQ ID NO: 2669 - DNA, 20 bp, Artificial sequence
  Synthetic oligonucleotide
ctgtatataattttttcaac

SEQ ID NO: 2670 - DNA, 20 bp, Artificial sequence
  Synthetic oligonucleotide
actaaatgtttatttgcatt

SEQ ID NO: 2671 - DNA, 20 bp, Artificial sequence
  Synthetic oligonucleotide
gaatttaaagaggaataaaa

SEQ ID NO: 2672 - DNA, 20 bp, Artificial sequence
  Synthetic oligonucleotide
aatttcattatgattatcgc

SEQ ID NO: 2673 - DNA, 20 bp, Artificial sequence
  Synthetic oligonucleotide
tcttcaaaccttttgaccaa

SEQ ID NO: 2674 - DNA, 20 bp, Artificial sequence
  Synthetic oligonucleotide
gaaataaattgttcattttg

SEQ ID NO: 2675 - DNA, 20 bp, Artificial sequence
  Synthetic oligonucleotide
gaaaaaatagtttattataa

SEQ ID NO: 2676 - DNA, 20 bp, Artificial sequence
  Synthetic oligonucleotide
tatatgattttttgcaaggg

SEQ ID NO: 2677 - DNA, 20 bp, Artificial sequence
  Synthetic oligonucleotide
gttaaaggaaatgtttatat

SEQ ID NO: 2678 - DNA, 20 bp, Artificial sequence
  Synthetic oligonucleotide
aaattaatcctttccaaatg

SEQ ID NO: 2679 - DNA, 20 bp, Artificial sequence
  Synthetic oligonucleotide
aatattagttgtcaaatgtc

SEQ ID NO: 2680 - DNA, 20 bp, Artificial sequence
  Synthetic oligonucleotide
ctctttgaggaagttactac

SEQ ID NO: 2681 - DNA, 20 bp, Artificial sequence
  Synthetic oligonucleotide
aataacaataacagttaatg

SEQ ID NO: 2682 - DNA, 20 bp, Artificial sequence
  Synthetic oligonucleotide
gattatcaagaaagataatg

SEQ ID NO: 2683 - DNA, 20 bp, Artificial sequence
  Synthetic oligonucleotide
gctactttctttcagttacc

SEQ ID NO: 2684 - DNA, 20 bp, Artificial sequence
  Synthetic oligonucleotide
gccagaggaccatagtggtt

SEQ ID NO: 2685 - DNA, 20 bp, Artificial sequence
  Synthetic oligonucleotide
tactaagtgaagtttgaggg

SEQ ID NO: 2686 - DNA, 20 bp, Artificial sequence
  Synthetic oligonucleotide
agaaaggctttaagatagct

SEQ ID NO: 2687 - DNA, 20 bp, Artificial sequence
  Synthetic oligonucleotide
aaggatgggctctgaagcag

SEQ ID NO: 2688 - DNA, 20 bp, Artificial sequence
  Synthetic oligonucleotide
cccaggagtttgctctcaaa

SEQ ID NO: 2689 - DNA, 20 bp, Artificial sequence
  Synthetic oligonucleotide
agagtctgctttcatatttt

SEQ ID NO: 2690 - DNA, 20 bp, Artificial sequence
  Synthetic oligonucleotide
tggaggcaggtctttttttt

SEQ ID NO: 2691 - DNA, 20 bp, Artificial sequence
  Synthetic oligonucleotide
acgatgtgaagatgggtcaa

SEQ ID NO: 2692 - DNA, 20 bp, Artificial sequence
  Synthetic oligonucleotide
ttaaactatattcaaatttg

SEQ ID NO: 2693 - DNA, 20 bp, Artificial sequence
  Synthetic oligonucleotide
aatgcacaaagggaaatctg

SEQ ID NO: 2694 - DNA, 20 bp, Artificial sequence
  Synthetic oligonucleotide
aattagctgactcacctaat

SEQ ID NO: 2695 - DNA, 20 bp, Artificial sequence
  Synthetic oligonucleotide
agcaaagaggtagtatgctg

SEQ ID NO: 2696 - DNA, 20 bp, Artificial sequence
  Synthetic oligonucleotide
gtttaaatacattcaaccat

SEQ ID NO: 2697 - DNA, 20 bp, Artificial sequence
  Synthetic oligonucleotide
ggtttggcagtggaggagag

SEQ ID NO: 2698 - DNA, 20 bp, Artificial sequence
  Synthetic oligonucleotide
cccttctagctgtttcttta

SEQ ID NO: 2699 - DNA, 20 bp, Artificial sequence
  Synthetic oligonucleotide
tatagagatgaagtttcatt

SEQ ID NO: 2700 - DNA, 20 bp, Artificial sequence
  Synthetic oligonucleotide
ccctattgcccaggctgtaa

SEQ ID NO: 2701 - DNA, 20 bp, Artificial sequence
  Synthetic oligonucleotide
ctttagagaacccagtctta

SEQ ID NO: 2702 - DNA, 20 bp, Artificial sequence
  Synthetic oligonucleotide
atagtcacattggtgaacgc

SEQ ID NO: 2703 - DNA, 20 bp, Artificial sequence
  Synthetic oligonucleotide
ttgctctccctcagttatgt

SEQ ID NO: 2704 - DNA, 20 bp, Artificial sequence
  Synthetic oligonucleotide
tgctattatatatgctaagc

SEQ ID NO: 2705 - DNA, 20 bp, Artificial sequence
  Synthetic oligonucleotide
ctgatgatctctggtgccac

SEQ ID NO: 2706 - DNA, 20 bp, Artificial sequence
  Synthetic oligonucleotide
ctactaacctgtaaaagaca

SEQ ID NO: 2707 - DNA, 20 bp, Artificial sequence
  Synthetic oligonucleotide
actttacaacaagataaaaa

SEQ ID NO: 2708 - DNA, 20 bp, Artificial sequence
  Synthetic oligonucleotide
tctggtacagtcctactacc

SEQ ID NO: 2709 - DNA, 20 bp, Artificial sequence
  Synthetic oligonucleotide
aatataatttatagcattac

SEQ ID NO: 2710 - DNA, 20 bp, Artificial sequence
  Synthetic oligonucleotide
tgaggcaatatgcagacgaa

SEQ ID NO: 2711 - DNA, 20 bp, Artificial sequence
  Synthetic oligonucleotide
tttagaaatgcatcaaagtg

SEQ ID NO: 2712 - DNA, 20 bp, Artificial sequence
  Synthetic oligonucleotide
caaactttaatttttgggaa

SEQ ID NO: 2713 - DNA, 20 bp, Artificial sequence
  Synthetic oligonucleotide
tgtatccaatgcccaaagga

SEQ ID NO: 2714 - DNA, 20 bp, Artificial sequence
  Synthetic oligonucleotide
catttattgtttacatactc

SEQ ID NO: 2715 - DNA, 20 bp, Artificial sequence
  Synthetic oligonucleotide
gcaaaacaatatgcatattt

SEQ ID NO: 2716 - DNA, 20 bp, Artificial sequence
  Synthetic oligonucleotide
gaggtcttgttttggaaagg

SEQ ID NO: 2717 - DNA, 20 bp, Artificial sequence
  Synthetic oligonucleotide
tggatactctgatttctctt

SEQ ID NO: 2718 - DNA, 20 bp, Artificial sequence
  Synthetic oligonucleotide
agcaaagggcatctgattca

SEQ ID NO: 2719 - DNA, 20 bp, Artificial sequence
  Synthetic oligonucleotide
accttgttaaaaagcaaggt

SEQ ID NO: 2720 - DNA, 20 bp, Artificial sequence
  Synthetic oligonucleotide
ggagtgtgtacatagtgtag

SEQ ID NO: 2721 - DNA, 20 bp, Artificial sequence
  Synthetic oligonucleotide
aaaatgaaatcaagcccaga

SEQ ID NO: 2722 - DNA, 20 bp, Artificial sequence
  Synthetic oligonucleotide
gagatagtagccaaaaagat

SEQ ID NO: 2723 - DNA, 20 bp, Artificial sequence
  Synthetic oligonucleotide
ttgttttgctgcattattga

SEQ ID NO: 2724 - DNA, 20 bp, Artificial sequence
  Synthetic oligonucleotide
caactttcacagccttaaac

SEQ ID NO: 2725 - DNA, 20 bp, Artificial sequence
  Synthetic oligonucleotide
tttggagcaatgtgatgttt

SEQ ID NO: 2726 - DNA, 20 bp, Artificial sequence
  Synthetic oligonucleotide
gagctgcagcaagttttttc

SEQ ID NO: 2727 - DNA, 20 bp, Artificial sequence
  Synthetic oligonucleotide
gctgctctttgagaaagttc

SEQ ID NO: 2728 - DNA, 20 bp, Artificial sequence
  Synthetic oligonucleotide
aagaaaaattgaaattcaag

SEQ ID NO: 2729 - DNA, 20 bp, Artificial sequence
  Synthetic oligonucleotide
aaaatagcaaggtttcatca

SEQ ID NO: 2730 - DNA, 20 bp, Artificial sequence
  Synthetic oligonucleotide
ttaaaaaagatatgctcatt

SEQ ID NO: 2731 - DNA, 20 bp, Artificial sequence
  Synthetic oligonucleotide
cactgcccgacatcaccaat

SEQ ID NO: 2732 - DNA, 20 bp, Artificial sequence
  Synthetic oligonucleotide
aaccacactcttctagaatc

SEQ ID NO: 2733 - DNA, 20 bp, Artificial sequence
  Synthetic oligonucleotide
taaggaaattatctttattc

SEQ ID NO: 2734 - DNA, 20 bp, Artificial sequence
  Synthetic oligonucleotide
tgtctttaggaatacaacta

SEQ ID NO: 2735 - DNA, 20 bp, Artificial sequence
  Synthetic oligonucleotide
gctaatagcttattgggaag

SEQ ID NO: 2736 - DNA, 20 bp, Artificial sequence
  Synthetic oligonucleotide
gggttgaatagctgatataa

SEQ ID NO: 2737 - DNA, 20 bp, Artificial sequence
  Synthetic oligonucleotide
agacttaaaagctatattag

SEQ ID NO: 2738 - DNA, 20 bp, Artificial sequence
  Synthetic oligonucleotide
tcagttcagtatcttatatc

SEQ ID NO: 2739 - DNA, 20 bp, Artificial sequence
  Synthetic oligonucleotide
accttttattctctctctac

SEQ ID NO: 2740 - DNA, 20 bp, Artificial sequence
  Synthetic oligonucleotide
taaaataaatgagaaaaacg

SEQ ID NO: 2741 - DNA, 20 bp, Artificial sequence
  Synthetic oligonucleotide
ccaatataacaaatgttaaa

SEQ ID NO: 2742 - DNA, 20 bp, Artificial sequence
  Synthetic oligonucleotide
gagtattcatgacttgtttt

SEQ ID NO: 2743 - DNA, 20 bp, Artificial sequence
  Synthetic oligonucleotide
tgttatctataaagaaatat

SEQ ID NO: 2744 - DNA, 20 bp, Artificial sequence
  Synthetic oligonucleotide
aatataacaacaaacacttc

SEQ ID NO: 2745 - DNA, 20 bp, Artificial sequence
  Synthetic oligonucleotide
tatgtttttctgaatatgtg

SEQ ID NO: 2746 - DNA, 20 bp, Artificial sequence
  Synthetic oligonucleotide
gcaatttcaggtgtcctagt

SEQ ID NO: 2747 - DNA, 20 bp, Artificial sequence
  Synthetic oligonucleotide
cccacataacttttattaca

SEQ ID NO: 2748 - DNA, 20 bp, Artificial sequence
  Synthetic oligonucleotide
cgtggttttgttttccatgg

SEQ ID NO: 2749 - DNA, 20 bp, Artificial sequence
  Synthetic oligonucleotide
atctatctaggtttgggtgg

SEQ ID NO: 2750 - DNA, 20 bp, Artificial sequence
  Synthetic oligonucleotide
ttatttctttaggtgtgatg

SEQ ID NO: 2751 - DNA, 20 bp, Artificial sequence
  Synthetic oligonucleotide
attctcattgggaaccctac

SEQ ID NO: 2752 - DNA, 20 bp, Artificial sequence
  Synthetic oligonucleotide
gtaaattgcaactaaaaaga

SEQ ID NO: 2753 - DNA, 20 bp, Artificial sequence
  Synthetic oligonucleotide
aaacatgttcattgcttaca

SEQ ID NO: 2754 - DNA, 20 bp, Artificial sequence
  Synthetic oligonucleotide
ggttctcctatagtcccagc

SEQ ID NO: 2755 - DNA, 20 bp, Artificial sequence
  Synthetic oligonucleotide
acatgatcggtgaggtcagg

SEQ ID NO: 2756 - DNA, 20 bp, Artificial sequence
  Synthetic oligonucleotide
tcgacaatagggtttacgac

SEQ ID NO: 2757 - DNA, 20 bp, Artificial sequence
  Synthetic oligonucleotide
ttaagtgggctattgttcac

SEQ ID NO: 2758 - DNA, 20 bp, Artificial sequence
  Synthetic oligonucleotide
actattgatgaagttaagtg

SEQ ID NO: 2759 - DNA, 20 bp, Artificial sequence
  Synthetic oligonucleotide
tgccataggacttaattctt

SEQ ID NO: 2760 - DNA, 20 bp, Artificial sequence
  Synthetic oligonucleotide
ttgacttgtttgtattaatc

SEQ ID NO: 2761 - DNA, 20 bp, Artificial sequence
  Synthetic oligonucleotide
cctgcagtaatggaacagcg

SEQ ID NO: 2762 - DNA, 20 bp, Artificial sequence
  Synthetic oligonucleotide
tgaactttgaaggatgtaca

SEQ ID NO: 2763 - DNA, 20 bp, Artificial sequence
  Synthetic oligonucleotide
ctaccctgtttgttgtttga

SEQ ID NO: 2764 - DNA, 20 bp, Artificial sequence
  Synthetic oligonucleotide
ttttccatgattttgaaact

SEQ ID NO: 2765 - DNA, 20 bp, Artificial sequence
  Synthetic oligonucleotide
acaacagggagaaggaaacg

SEQ ID NO: 2766 - DNA, 20 bp, Artificial sequence
  Synthetic oligonucleotide
atgacagagcttttgtgatg

SEQ ID NO: 2767 - DNA, 20 bp, Artificial sequence
  Synthetic oligonucleotide
ttcacttcttggtagatacg

SEQ ID NO: 2768 - DNA, 20 bp, Artificial sequence
  Synthetic oligonucleotide
ctaaaaaaaatccaaataat

SEQ ID NO: 2769 - DNA, 20 bp, Artificial sequence
  Synthetic oligonucleotide
agtaagaaaaggtcacacta

SEQ ID NO: 2770 - DNA, 20 bp, Artificial sequence
  Synthetic oligonucleotide
attttcaacaacatgtctga

SEQ ID NO: 2771 - DNA, 20 bp, Artificial sequence
  Synthetic oligonucleotide
aaaggtaagtgaaaattcaa

SEQ ID NO: 2772 - DNA, 20 bp, Artificial sequence
  Synthetic oligonucleotide
ctcagcctgaaatggtcatg

SEQ ID NO: 2773 - DNA, 20 bp, Artificial sequence
  Synthetic oligonucleotide
agactgagactatacatatt

SEQ ID NO: 2774 - DNA, 20 bp, Artificial sequence
  Synthetic oligonucleotide
aacttttataaccacttata

SEQ ID NO: 2775 - DNA, 20 bp, Artificial sequence
  Synthetic oligonucleotide
aaaggtaaaaagtttggaag

SEQ ID NO: 2776 - DNA, 20 bp, Artificial sequence
  Synthetic oligonucleotide
attatgtaacaactacctat

SEQ ID NO: 2777 - DNA, 20 bp, Artificial sequence
  Synthetic oligonucleotide
gttacaatgaaaccccatct

SEQ ID NO: 2778 - DNA, 20 bp, Artificial sequence
  Synthetic oligonucleotide
ttattgctgggtgcagtggt

SEQ ID NO: 2779 - DNA, 20 bp, Artificial sequence
  Synthetic oligonucleotide
ccaaagatatttttcacaag

SEQ ID NO: 2780 - DNA, 20 bp, Artificial sequence
  Synthetic oligonucleotide
aaacattgcggcaacatggg

SEQ ID NO: 2781 - DNA, 20 bp, Artificial sequence
  Synthetic oligonucleotide
aaatcttacatatagggatg

SEQ ID NO: 2782 - DNA, 20 bp, Artificial sequence
  Synthetic oligonucleotide
tccttcttcattctaatatt

SEQ ID NO: 2783 - DNA, 20 bp, Artificial sequence
  Synthetic oligonucleotide
ctttacaccacactctttca

SEQ ID NO: 2784 - DNA, 20 bp, Artificial sequence
  Synthetic oligonucleotide
cctttacaccacactctttc

SEQ ID NO: 2785 - DNA, 20 bp, Artificial sequence
  Synthetic oligonucleotide
tcctttacaccacactcttt

SEQ ID NO: 2786 - DNA, 20 bp, Artificial sequence
  Synthetic oligonucleotide
ttcctttacaccacactctt

SEQ ID NO: 2787 - DNA, 20 bp, Artificial sequence
  Synthetic oligonucleotide
attcctttacaccacactct

SEQ ID NO: 2788 - DNA, 20 bp, Artificial sequence
  Synthetic oligonucleotide
aattcctttacaccacactc

SEQ ID NO: 2789 - DNA, 17 bp, Artificial sequence
  Synthetic oligonucleotide
tttgttaatagttctct

SEQ ID NO: 2790 - DNA, 17 bp, Artificial sequence
  Synthetic oligonucleotide
ttttgttaatagttctc

SEQ ID NO: 2791 - DNA, 20 bp, Artificial sequence
  Synthetic oligonucleotide
ttttttgttaatagttctct

SEQ ID NO: 2792 - DNA, 20 bp, Artificial sequence
  Synthetic oligonucleotide
tttttttgttaatagttctc

SEQ ID NO: 2793 - DNA, 20 bp, Artificial sequence
  Synthetic oligonucleotide
atttttttgttaatagttct

SEQ ID NO: 2794 - DNA, 20 bp, Artificial sequence
  Synthetic oligonucleotide
ccaacatttgtcacttgctc

SEQ ID NO: 2795 - DNA, 20 bp, Artificial sequence
  Synthetic oligonucleotide
cctataggactatccaggaa

SEQ ID NO: 2796 - DNA, 15 bp, Artificial sequence
  Synthetic oligonucleotide
ctacatagagaacac

SEQ ID NO: 2797 - DNA, 15 bp, Artificial sequence
  Synthetic oligonucleotide
gcctacatagagaac

The invention claimed is:
1. A modified oligonucleotide according to the following chemical structure:
(SEQ ID NO: 1703)
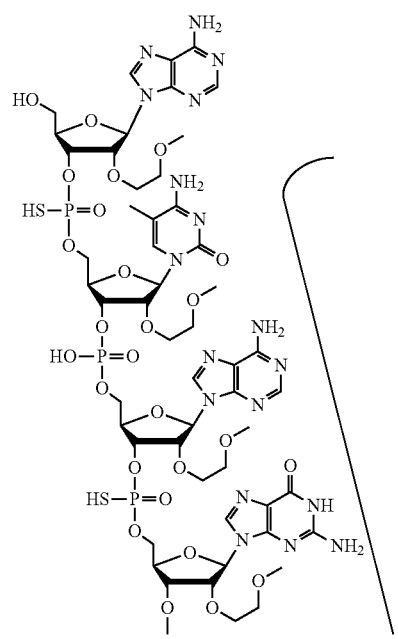
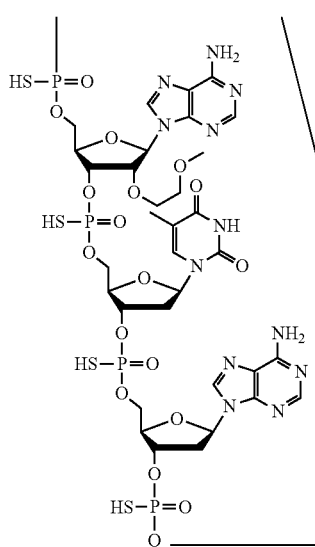
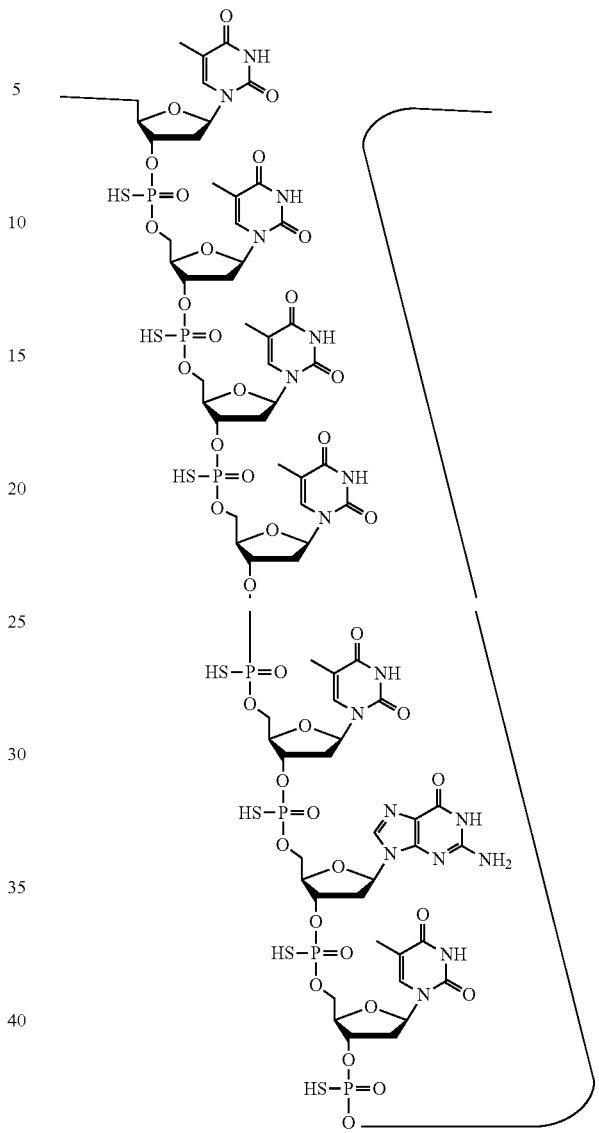

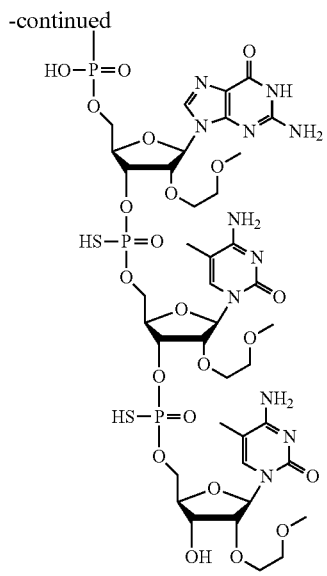

or a salt thereof.

2. The modified oligonucleotide of claim 1, which is the sodium salt or the potassium salt.

3. A population of modified oligonucleotides of claim 1, wherein all of the phosphorothioate internucleoside linkages of the modified oligonucleotide are stereorandom.

4. A pharmaceutical composition comprising the modified oligonucleotide of claim 1 and a pharmaceutically acceptable diluent.

5. The pharmaceutical composition of claim 4, wherein the pharmaceutically acceptable diluent is phosphate-buffered saline (PBS) or artificial cerebrospinal fluid (aCSF).

6. The pharmaceutical composition of claim 5, wherein the pharmaceutical composition consists essentially of the modified oligonucleotide and phosphate-buffered saline (PBS) or artificial cerebrospinal fluid (aCSF).

7. A method comprising administering to a subject the pharmaceutical composition of claim 4.

8. A method of treating a disease associated with SNCA comprising administering to a subject having or at risk for developing a disease associated with SNCA a therapeutically effective amount of a pharmaceutical composition of claim 4, thereby treating the disease associated with SNCA.

9. An oligomeric compound comprising a modified oligonucleotide according to the following chemical notation:

Aes mCeo Aes Ges Aes Tds Ads Tds Tds Tds Tds Tds Gds Tds Tds mCeo Teo Ges mCes mCe (SEQ ID NO: 1703); wherein, A=an adenine nucleobase,
$^m$C=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

10. A pharmaceutical composition comprising the oligomeric compound of claim 9 and a pharmaceutically acceptable diluent.

11. The pharmaceutical composition of claim 10, wherein the pharmaceutically acceptable diluent is phosphate-buffered saline (PBS) or artificial cerebrospinal fluid (aCSF).

12. The pharmaceutical composition of claim 11, wherein the pharmaceutical composition consists essentially of the oligomeric compound and phosphate-buffered saline (PBS) or artificial cerebrospinal fluid (aCSF).

13. A pharmaceutical composition comprising the population of modified oligonucleotides of claim 3 and a pharmaceutically acceptable diluent.

14. The pharmaceutical composition of claim 13, wherein the pharmaceutically acceptable diluent is phosphate-buffered saline (PBS) or artificial cerebrospinal fluid (aCSF).

15. The pharmaceutical composition of claim 14, wherein the pharmaceutical composition consists essentially of the population of modified oligonucleotides and phosphate-buffered saline (PBS) or artificial cerebrospinal fluid (aCSF).

16. The method of claim 8, wherein the disease associated with SNCA is a neurodegenerative disease.

17. The method of claim 16, wherein the neurodegenerative disease is Parkinson's disease, dementia with Lewy bodies, diffuse Lewy body disease, pure autonomic failure, multiple system atrophy, neuronopathic Gaucher's disease, or Alzheimer's disease.

18. The method of claim 17, wherein the administration improves motor function, reduces of alpha-synuclein aggregates, reduces neurodegeneration, and/or reduces dementia in the subject.

19. A method comprising administering to a subject the modified oligonucleotide of claim 1.

20. A method of treating a disease associated with SNCA comprising administering to a subject having or at risk for developing a disease associated with SNCA a therapeutically effective amount of the modified oligonucleotide of claim 1, thereby treating the disease associated with SNCA.

21. A method comprising administering to a subject the oligomeric compound of claim 9.

22. A method of treating a disease associated with SNCA comprising administering to a subject having or at risk for developing a disease associated with SNCA a therapeutically effective amount of the oligomeric compound of claim 9, thereby treating the disease associated with SNCA.

23. A method comprising administering to a subject the pharmaceutical composition of claim 10.

24. A method of treating a disease associated with SNCA comprising administering to a subject having or at risk for developing a disease associated with SNCA a therapeutically effective amount of the pharmaceutical composition of claim 10, thereby treating the disease associated with SNCA.

25. A method of treating a disease associated with SNCA comprising administering to a subject having or at risk for developing a disease associated with SNCA a therapeutically effective amount of the pharmaceutical composition of claim 13, thereby treating the disease associated with SNCA.

* * * * *

UNITED STATES PATENT AND TRADEMARK OFFICE
CERTIFICATE OF CORRECTION

PATENT NO. : 11,230,712 B2
APPLICATION NO. : 16/759698
DATED : January 25, 2022
INVENTOR(S) : Holly Kordasiewicz et al.

Page 1 of 1

It is certified that error appears in the above-identified patent and that said Letters Patent is hereby corrected as shown below:

In the Claims

Claim 1, Column 295, Line 8, to Column 297, Line 22, the structure should read as follows:

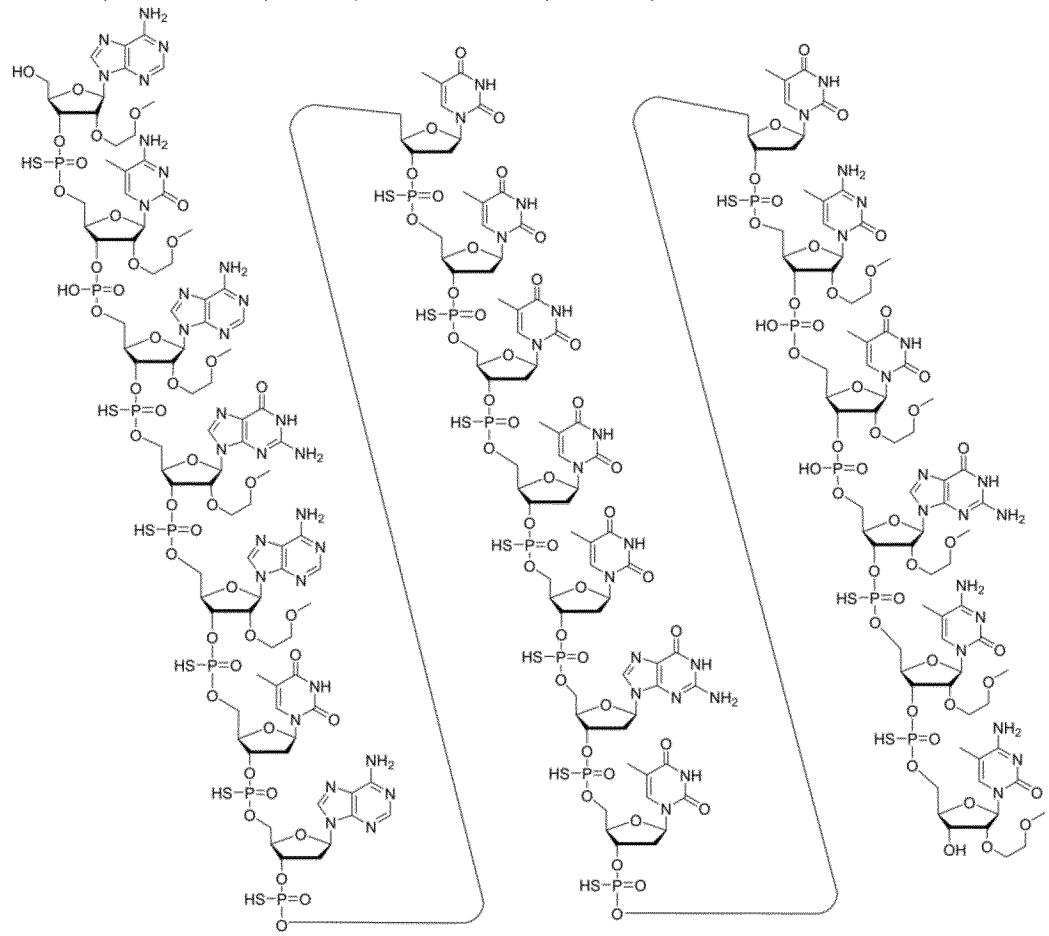

Signed and Sealed this
Eleventh Day of October, 2022

Katherine Kelly Vidal
*Director of the United States Patent and Trademark Office*